United States Patent 10,233,495 (METHODS AND COMPOSITIONS FOR SCREENING AND TREATING DEVELOPMENTAL DISORDERS) - sequence listing, part 207

SEQ ID NO: 1688 - DNA, 126060 bp, Homo sapiens
cctatgccctagggctagtggaagacttaagatggcggcgtttgcacggagtgcaatcactgcgtccttacgggggttgcaaggcgtccgaagtatgagtccactaacaaaagtccagaaactcgccagttaatagtattgtggtgagtgatgagcctcacgttggctagagaagtggccgttagcgaggctacacactttgggatcgcgtggcctgagtcgggggagtaaccggcctgtattccatttttctctctccagtctcttcaaaatatcggagaataatttctttctcgctgatcgcctaacttctactgacgaagcttggaagttgcagaaggtagctcctaggagggatatatgggtcgttctttcctttttccttatttaaatgggtttttattgacaccatgtcgcgccaaaatggattccatctcctcagagctttcctaggaacagcctaacctcttgggcctaactttattttttttttgttctgcctttcatgtccagacttattagttttaattaatttgtttgtaacgtattcattatgcactagattaaacaatttttttctgtgcccactataccccaaatgtggagttttgggcaaaaacttaacatttgttcttgaagcatctcagaggtgtgtgtgtgtgtgtgtaatctttgggggacttacattgccaggttgattactcactaagaaaagagctagatttcctgttttcaaatctgttggcgaaattaagtttatgttaagcatagcatgtttactatatatatggggaagacagttaagagtgacatctaatatgttgttaaatgcttatgtgattaaagtaaatttcatgcattaccgcggagtatgaattgctgcaaccttttagaaaagaatctggcaatatttagggaaataaaaaatacagatatcacttgaacaaaaactggaattcaaaagtctgacttttaagaatctatcctacagaaataaaagtaccagtatataatgacgcatgaacaaggatacttttgtactattttgttcttgtgacaactggaaacaacctgtgtatccatcaataggagaatgtttgagtaaattttggtacataaatattatgaaatattttgacttttgacctagagaatcttatgatggatggttatgtgagaaaagtaagttgcagaatagtctagtatgagtccttttttttttttgatggggtgatgaaggaatgcaagattaacttctttatcttttggaggagacgttaaatatattatgaaatacttaagacatatacagatatacaaggaataatacaatgaacctctcttctcaccacccaacgtaaaaaaaaaatcaaacattaacgtgacagttgaagttctctgtgtacccatccctgattgcatctctctcttctctcatccccagaggtaaccattattttaaacttagtgatttttaccatgcatttcttaaacttctgtgacatagcaacttctagcatggattattttttgtaaatattgaagatgaatttttaaaaaaagtcaatgaaagaagaaagcaagtgtctatctgactttttttttttttttttttttgagatgaagtcttgcttgttgccccggctagagcgtagtggcgcaatcttggctcactgcaaccttcaccaccccagttcaagcgattctcctgcctcagcctcccgagtagctgggattgcaggcgcctgccactgtgcccggctaattttaatttaattttaatttattttatatatatatagagagagagagagggagagagacagacagacatggagtcttgctctgtcacccaggcaggagtgtagtggctcgatctcggttcactgtaacttccgcctcctgggttcaagcgattctcatgcctcagcatccagagtagccgagattacaggcacaccttgccacgcctggctaatttttgtatttttagtagagacgggtttccctatattggccaggctggtctccaacccctgacctctggtaatctgcctgcctcggcctcccaaagtattgggattacaggcgtgagccactgtgcccagccttatctgactattactgtaacagtggccaatcaaaattccttcttttctttttttttttccttgagcctagaaatttcttaattgaggggagaatctagcaagcagttgagtcaaagggtgtagattatactacagtggtaaagaaagtaagcagctggcagtgaaagcaatctcaagcaaataatgaatgttccatgaacaagatgcctgaattgaaaaacagaacaaaaccaactaaccaaacaaaaaacaatccgtggatcctaactcaaatccaaggtgatttgagcctgcacttgtaattagacaaaatctatgaacttcagttgccttggaggcatctgagggaaatgaggttgcatgtagatgaatcagttgtttctggcatcatgttagtgtgattacatttagctgctgtgtgcaaaacattttagcaatcatttaggtccaggacgtggaatttattagtgcaacaaccctgtaaacagtggttagaacattaataattttattttatttatgttttatttattttttgagacggatttttgctcttgttgcccaggttggagtgcaatggcgcgatctcggctgactgcaacctccacctcctggattcaagctattctcctgcctcagcctgccgagtagctgggattacaggcatgtgccaccgcacccagctaattttgtattttttagtagagatggggtttctccatgttggtcaggctggtcttgaactcctgacctcaggtgatccgcccacctcagcctcccaaagtgctgggattacaggcgtgagccaccgcgcccggccagaacattagttttaaacttcctaacccttgggagaaggcaaaacacttgatgaaatctacataaagactaaaacattttaccaattttgcattgtttgtttgaaattgcattgacgactggtatgttaattttgtatatatttttatgagaacaatgttggacatcatttaatttttttaggtttttttaattgattattgattggttcatttgcaggaactgactattagtaatcaaggatacaaattgttaagagaatatgttacagagaaaaacttgacaagctagacttagatttttgtcgttaaagataatttgtgggatatgatttttataaggagttgcattaaatagaatgtcttacacagatttaagaggttaataattataaaattaagatgagttcttataaaatattcttgaggtataataaaattatacttgtggagtatatctttgaataacatttaaaagcaaactaatactttccaggtaaaataattatcaacataactttttaaaaataattcatagtacttcaggttatttctatgtttgacacattaacttaaaagaaaaaaggaaaatggtgattagttaatgccatacacactggacagaaaagaaacttagctcttatggattcctctccatattttgcagcagggtaaatgtaagttttcttacgtagctagatactgtgttccagtgctgttgatgttgtactgttttagcaatgaagagattgatatgggctgattgggggttagggaaagtgaagcagcagaaccagaacagagtggacatttaaagggtgctaataagtaaataattatgtgaagtagcatactggtcgaaatgcataactcaaagataatcgggaagcgtattttcttttcttttcttttttttttttgagatggagtctcgctctgtcgcccaggctggagtgcagtggcacgatcttggttcactgtaagctccgcctcccaggttcacgccattctcctgcctcagcctcccaagtagctgggactacaggcgcctgccaccatgcccagctaatttttttgtatttttagtagagacggggttttaccgtgttagccaggatggtctcgacctcctgacctcgtgatctgcccgcctcggcctcccaaagtgctgggattacaggcttgagccaccgcgcccggccgggaagcatgttttctgaaacataacctaagaaagtataaatgctgccttgtgcctacaatcctggtgacaagagcaagacttcgtctcaaaaaaaaaaaaaagtataaaagctccttaaaggatgtttcaaaataatgaataatattaatttctatattgtatattcacaaatgttctttctagaataattatttgcttaatggggtgcatgtttagttggtgagaaatgaattaataggttagtgatttattatctgttgggaaaaattttagacattcacatgaaagtagagagaataacataaatgaatttccatatatggatcacttagatttagcaaccgttatgattttgccttacttgccttttcccccaaaatactgtaaagtaaattacagttatcatgacattttcttctaaataagtcaatataaacatataataaacaaggacctttttctatatagtcacaatgccatcactatacatagtaggattaacagtaattccgtaattttttttttgtttttgagatgaagtcttgctcttgtcacccaggctggagtgcaatggtgtgatctcggctcactgcaacctcgacctcccgggttcaagtgattctcctgcctcagcctcccgagtagctgggattacaggggcctgccaccatgcccggctaatttttgtatttttggtagagatggggtttcaccatgttagccaggctggtctggaactcctaatctcaggtgatccgtctgcctcggcctcccaaagtgctgggattacaggcgtgagccaccgcgcccggccattccttaatgtttaacacccagtgcatattcagattttcccagttgtccgcaggatgtcttttatagctgctttcttcaaaccaggatctattcggagaccacacattgcatttgatttttatgtcttttgagccttttaaaatttagagcagttccctataaccccttcttttgtttgttttatgaaattggcttgttgaacttcacaaaacacgagttggggtcatgccaactgtaccgttagtgattagtttacatatagggaaaataatttgtgaatgttggtccattcactctgccagctataccatggcagcatttccagtatcaggaaagcaaaccaggggatctaaaactgagcattaaaaactctcccctatccagtgaaagagataagaatgccagttgtgagaaaattgaaggggaaacggagaatgtcagtgttaaagatatttgaactttttttttttatccatttgaaaggtattttttttgggtgaactatttgttaatattcttggtcctgtaaaaaaaaaattggtgtttggactttttcttattgtagacactcttcataaattaaggaaattcgcctttttttgttataatattgcagactttttttttttttgagatggagtcttgctctgtcgccaggctggagtgcagtggcacgatcttggctcactgcaacctccgcctcccaggttcaagcgattctcctgcctcagcctcccgcgtagctgggactacaggcgtgtggcaccatgcccagctaatttttgtatttttagtagagatggggttttaccatgttggccaggatggtctcgatctcttgaccttttgatccgcccgccttggcctccgaaagtggtgggattacaggcatgagccactgcacccggcctgcagatatttttttcagttagctacttttcttttcactttatagtatttttttacttaattgtggcacaatacacattagtgttttagccattttaaagtatacaatttagtggcatttcatacattcacagtgttgtgcatccatcactgctgtctagttccaacagattttaatcacttctaaaagaaaccctgtactcattccctttgccctctatcccatggctactaatttgctttctgtttatggatttgcctgttctgaatattgtatacaagtgggatcatatatagtagacccttgaggaatgggggggttagggtcaccaacccctcatacagtcaaatctgcataaaatttttaattccaccaaaacttaactaatagcctactgttgactggaagccttaccaataacatagtcaattaacacatactttctatggtaatttattatctactatattcttgcaattagctagagaagaaaatgttattaaaaatcagaaggaagagagagtatatttacgattcattaaatgtaagtggatcatcatgaaggtcttcatcctttttgtcttcatgttgagtaggctgaggaagaggaggggttggtcttgctgtctagggagtggtagaggtggaaaagatggaggaggcaggagaggcagacatacctggtgtaacttttactgaaaaaaaatacataaaagtggacccacgcagttcaaaaccatgttcaggggtcaactgtaatatgtgatctcttgtgtctgacttctttcatttagcataacatcttcaacattcatccatactgtagcatataatttgtacttaattcctttttatgattgaataatctatatatgaatgtaccaccttttgttcatcagttgatgaatgtatttacatgcatttaaataaaatttttttttttgggttttttttttgagacggattctcacccaggctggagtgcagtggcacgatctcggctcactgcgacctccgcctcccaggttcaagcgattcttctgcctcagcctcccgagtagctgggattacaggcacacgccaccatgcccggctaattttttttgtatttttagtagagacggggttttaccatgttggtcaggctggtctggaactcctgacctcgtgatccgccctcctcggcctcgcaaagtgctgggattatagtcgttagccaccgcacacagccaagaaaatgtatttaaagaaaatatggggctgggcatggtggctcacacctatacttccagcagtgtaggaggccgaggccggcagaacggttaagcccaggagttcgagactaacctgggcagcatgatgaaaccccatctctccaaaaaatacaaaaattagctgggtataatggcctgcacctgtagtcccagctacttgggaggctgaagtgggaggatcgcttgagcctgggaggtagaggttgcagtgaactgaaatcacgccactgcactccagcctgggcaactgggtgagggtctgtctcaaaaaaagaaaaaagtaagacaatatggtataaattggggatggtgaagggacataaagaaaagttagtttctaaactggacttgaattaatgttgacagccgtagaatgtaataagtaatgtatatatataatgtgaagcaaccactaaaaatgccatgcatatatgcaaaaactctagagaggaatcagaattttataaaatgttcagctaactcacagaaaggcagataaaaacagacaaatagaaaactaagaacaaaggaaaaataaatcgcagacttaaaccctaacatatgaacaattacattagatttaaatcgtttaaatgtaccatttaaaagataagagattttcagagtggcaatgacgtaactgtatgtgttaatatgagacttcaaatatgactatataggctgggcatggtagctcacacctgtaatcctggcactttgggaggccgaggtgggtggatcacctgaggtcaggagttcaagaccagcatggccaacatggcaaaaccccatttctactagaaatacaaaaaattagccaggcgtggtggcacacacctgtagtcccagatactcgagaggctgaggtaggagaatcacttgaacccgggaggcggaggttgcagggagccgagatcgtgccactgcactccagcctgggagagagagtgagactccatctcaaaaagcaaacaaaaaacccccccaaatatgactgtataagcagattgaaagtaaaaggatgggcaaagatataccatgcaaactttaatcaaatgaaagcagtactggctatgttagataaagtaggcttcagacaaattactatagacaaaagagggatgttttataatgaaattcaccaagaagacatggcagttctaaagcacctgtatcaaacaatagagctacaaaatatgtgaagcaaaaactgctagaactgaaagtagaaatagacaggtccataattatagttggagagttcagcagccttctcacaacaactggcagaacaattagaaaatcagcaagtacacagttcaacaatgtaataaaccaacaagatctaattgccatttatagaatgctcaacaactgtagaattattacattttgaatatattatatgttatatattttatatatatatattttatatatatatatatattttgagacaagagtctcgctcttgtcacccaggctagagtgcagtggcgcgatctcggctcactgcaacctctgcctcctgggttcaagcgattctcctgcctcagcctcccaaggagctgggattacaggtgcccgctaccacgcctggctaatttttgtatttttagtagagacggggtttcaccatgttgtccaggctggtctcgaactcctgaccttgggtgatcctcccgcctcagcatcccaaagtgctgggattacaggcgtgagccaacgtgcctggctgaccccaaatacttttaacaaagtattaacacattgattccagcaatatatgaaaagaaattgatagaccacgaccaagttggaatttttatagttatataagattggttcagcaattgaaaatcaatcttatggatatgtaagattggttcagcatttgaaaatcagtcaatataatgtactatatcagcagtctgaaaaacaatcataattgattatattgatgcagaaaaaaacatatgacagagtcaaatacctattcttgataatgattttcagaaaatgaggaataagtatctataaaaaaactgtagctgatattatacataatggtgaaaaactgactcttacccctaagatcaggaaaaagcaaaggatgtccattcttatcttccttattcaacatagtaatagaaattcaagccactgtagtgaggtaagaacaagaaataaaagatatcccaattggaaagaaagacatttgtccctatatgcagatggcatgattgtctatgtagaaaatctcaaggaatctaaaaaacaacccccaaatttctagaactaatgagttagtaacaccacaggctaaaagatctacacacaaaaatgaatgaatcacgttgcttttttttttttttgagatggagtctcgttctgttgccaggctggagtgcagtggcctgatctcggctcactgcaatctcggctcactgcaatttctgcctcccgggttcaagtgattcccctgcctcagcctcctgagtagctgggaatacaggcatgcaccaccatgcccggctaattttttgtgttttagtaaagatggggtttcaccatgttggccaggctggtctcgatctcctgacctcatgatctgcccgccttagcctcccaaagtgctgggattacaggtatgagccactgcgcccggaatgaatcacatttctatatactagcaatttaatatgtggaaacggaaattatatacaaagtaccatttacaagcactgcaaagaaacacaacatttagacataagtaaacatgtacaggacttgtattttgtaaattacaaaatgctggtgaaagaaactcaggaagtcctatataattgaaaagacttatcatgttcatgacttgggaaactcaacatagtaatgatgtcaattctccacaaattgataggtttaatggaatttccatttaaatcctagtatgtttttgtagatatagaaaagcttattttaaaatgtatgtggaaaggcacaggccttaaaatagctaaaaccatcttgaaaaatagtacattggtagaatcattaacttgacattaatgcctactatattcctatattaagacagtgttgtattggtggaggatagacacataaatcagtgtaacataattgagaactgagaaatagacatatacaattaggcccgactgaattttgtcaaacgtggaatagcagttcagtaatgaaagaaagcctttttaacaatggtgcttgaccaattgtccatctgtaggcaaaaagatgaacctgagtctcatatctaatacaaaaatgtactcaaaatgaattagagacttaaatgtaaaacttaaaactataaaacttttagaagaaaacataggaggaaatcttcagtttgtgctaggcaaggagttcttactcttaatatgcttaaaaggatgatctgtaaaaggaaaaattgatgaattaaattttattgaagttagaaactcttgttctgctaaagactctgttaagagaatgaagagaggctacagagtaggataatttatttgtaaaccacatatcttgcaaattaattgtatttagaatacataaactctggaaactcagtaaaaaagcaaccagtccaattagaacatgagcaaaagacatgaagagattatttcatggaagaagatacacagatggcaaataaaataaaaggatgtttaacattattaaccattttggaaatgcacattaaaatcacaacagaaatcactgtacacttatcaaatagtcataacaccaagtattggttaggatgaagagaatatggattacttatccactgctgattggaatgtaaaatggcatagcccctctgggaaactgtttggtagtttcttattaaaataaacctgcaggccaggtggggtggctcactcctgtaatcccagcactttgggaggcagaggtgggctgatcacctggaggtcaggagtttgagaccagcctgaccaacgtgaagaaaccccgtctctactgagaatacaaaaattggctgggcgtggtggctcacgcctgtaatcccagcactttgggaggccgaggtgggcggatcatgaggtcaggagatcaagaccatcctagctaagatgaggaaaccccgtctttactaaaaatacaaaaaataagccgggcatggtggtgggcgcctgtagtcctagctactcgggaggctgaggcaggagaatggcgtgaacccgggaggcagaatttgtggtgagcagagatcgcgccactgcactccagcctgggcgacagagactctgtctcaaaacaaagcaaaaattaactgggtgtggtggtgcatgcctgtaatctcagctactcgggaggctgaggcaggagaattgcttgaacctgggaagcggatgttgcggtgagccgagattgtgccattgcactccagcctgggcaacgagcgaaactccgtctcaaaaaaacaaaaccaaaacaaaaaaccacaaacctgcaactaccatatgacccagcattttcattcttgagtgtttatcccagagaaatgaaaacttaacgttcttgcaaaaatttgtgtatgaatgttcatggcatctttgttcatgatagtaacaacacagaagtgcccagatgtcctttaatgggtgaatggctaaacaaatggtggtgcattcataacataataccacacaggaatgaaaaacaaagctgatgcacaaaacaacctggatgaattcccagagaattatgctgaatgaaaaaagccaatctctgacgtatagttacatactatattatactatttacataatattctttttttttctttttttttttgagatggagtctcactctgtcgccaaggctggagtgcagtggcacgatctcggctcactgcatcctccacctcctgggtacaagtgattctctgcctcagcctccagagtagctgggtttacaggcgccagccaccatgctcggctaatttttgttttagtgattctcctgcctcagcctcccgagtagctgggactacaggcgcgcgccaccatgcccgtttaatttttgtatttttagtagagatggggttttactatgttggccaggctggtcttgaactcctgacttcctgatctgcccaccttggcctcccaaagtgctaggattacaggcgtgagccaccgtgcccagcctgataccttgttttctacaagaatgttaggttaactgatagggaagttgtcactgagtagacatcagataatgtttttgggatagggcaataagccataaggtgggggcagatctaggggaacatctagctgaggtggtggccaatagttttcttttttttcttttttttgagaagaagtctcactcactcagcccaagctggagtgcagtggcacgatctcggctctctgcaacctccacctcccgggttcaagcgattctcctgcctcagcttcccgggtagctgggattacaggtgcccgccaccatgcccggctaatttgtgtattttcagtagagatgaggtttcactgttggcgaggctggtcttgaactcctgacctcgtgatccacccgccttggcctcccaaagtgctgggacaagcgtaaaccaccacccccggccaacagttctcaatatgtggacctttcaagggatctgtaaagtgaaagctgtttttcttaatactaagttgtttttaccgtattgacatctttactgatggtgttgaagcagtggaaaataaacattttacctgaatacaaatcaaggtagtggcaccaaattgtatcagtagtcattgtattcttcaccccacacctgtagttttttttaaaaaaagtcagtttcttttaagaatgtctttgatgagggtggggcaccgtggcttatgcctgtagtcttcgctgcttcgtaggctgaggtgggagtctgaggcgggaggattccttgagcccaggagttcgaggctaagagtgacctgtggtcgtgccactgcactccagcctaggtgacagagtaagactctctcaaaaaatgtctttgatgagcagtaaagttactagtttcattaaatatggacccttgagtacgtgtcttcttaatatggtgtgatgaaaagggaagtatgcgtgaagcagttctgcaaactgaattttaaattatcttgaggaaaatcacctgtaacattgtcagcaagctgtactgctcactttttaaaatttacaacattatacttagaagaataactaatagacaagctacagttttttacacttgggtattgaccagatatgtttttctaaataaaatgggcttatcctttcaaggaaaacaactgatagtacttgttgcctattttaaattagctttcaaacaaaatttagaatttctgtatacttgtatctacttctgtgaacttgatagcttcccagtacttaaagacttttctgttaacatcagattttaaagaaagtggtttttaaatattgcttaatgaaatatgtcaacatttgaaacatctgcattgctcagtgaaacagtattttgtaaatgatccatttaggatgttaaaaatcatgcatggctgggcatggtggctcacgcctgtaatcccagcactttgggaggctgaggcaggtgaatcacctgaggtcaggagtttgagaccagcctggccaacatggtgaaaccctggctctactaaaaatacaaacaattagccaggcgtggtggcaggcacctataatcccagctactcgggaggctgaggcaggagaattgcttgaacccgggaggtggaggttgcagtgagccgagatcacgccactgcactccagcctgggtgacagggtgagactccatctcaaaaagaaaaaaaacacaaaacaaaaaaccaaggagtatgactgccggttcatatggtaagagtatatttagttttgtgagaaaccacgaaactgtcttccaaaattgctgtactgttgatgcattcccaccagccatgaatgagagttcctgttgctccacaatctcaacagcatttggtgttaccagtgttttggattttcaccattctaataggtgtgcaatgggactgtttaatttgcaactccctaatgacatacaaagttgagcatgttttcatgttcttatttaccatctgtatatgttctctggcgagatttctgttgacatcttttgtccattttaaaaattgggctatttattgagttttaagtgctgtctgtatgttttaggtaacagtcctttatcagttatgtgttttgcagattttttttgacttatcgtttcatattttaatggtgtcttttgtggagtaatttttttttaattttaataacatttagcttgtcaatgatttcttttatggattatgcttttggtattgtatctagaaagtaattgccatacccagtgatgtctagattttctcaaatgttggagttctatttacagttttgcattttacatttaggtctggcatccattttgaattaatatttgtgaagggtgtaaagtttgtattagattcattttttggcatttggatattcagctattccaacactatttgttgctccattgtattgcctttgcttctttctcaacgattagttgactatatttatgtctctatctgggctctttattctgttccattgatccatttatccattccttcaccaatttcacactgtctggattaccatagctttttattaagtcttgaagtcaagcagtgactattctttttttttttttttttttgagactgagtctcgctctgttgcccaggctgaagtgcagtggcacaatcctggctcaccgcaacttctgcctcctggattcaggcgattctcctgcctcagcctcccaagtagctgggattacaggcacacaccaccacacccaactaatttttgtatttttagtagagacgggcttttaccatgttggccgggctggcctcgaactcctgacctcaagtgatctgcccgtcttggcctcccaaagtgctgggattacaggcgtgagccactgtgcctggcgcagtgactttattatttccccttcaatattgtgatggatattttgagtcttttggctctccatataaaattcacaatcagtttgctgatatccacaaatatgctgggagtttggaattgcatgaaatctgtagatgaagttgggaagaagtgacatcttgacagtattgtctttgtatccacaaacatagaatatctctccatttgtgtaatttttttttctttcattagacttttgtagtttttttttttcatatagatcttgtatgtattttggtagatttatacctaaatatttcatttttggggctgctagtgtatatgctattttgtttttaattccacctgttcattgctggtatattgggaagcaattcgctactgtatgtgtgtgtgtgtgtgtgtgtatatatattttgagacggagtttcactcttattgcccaggctggagtgcaatggcgcgatctcggcgccccacaacctccgcctcccaggttcaagtgattctcctgcctcagcctccctagtagctgggattacaggcatgtgccaccacgcctggctaattttgtatttttagtagagacagggtttctccatgttggtcaggctggtctcgaattcctgacctcaggtgatccccccgcctaggcctcccaaagtgctgggattacaggcatgagccaccgcgcccggccttgctactgaatatgaaccttggttttttttggttgattgttttggaatgtctacatagatgatcatgttatctgtgaacaaagacagtgtgagttcttccctcccagtgtgtgtaccttttatttcctttttttttgtcttatttcattaggtaggacttccagtacaatattggaaaggagcggtgagaggagacatgcttgccttgttcttgatcttaatggaaaggtgttcagtttcttaccttttttttttttcttttttttgagatggagtctcactcttgttatccaggctggagtgcaatggcacgatcttggctcactgcaacctctgcctcccgggttcaagcgattctcttgcctcagcctccctagtagctgggattacaggtgcctgccaccacacccagctcatttttaaatttttaatagagacagggtttcactatgttggccagacttgtctcgaactcctgacctcaggtgatccgcctgcctctgtgtcccaaagtgctgggattacaggcgtgagctactgcgcccagccagtttcttacctttaagtatgttgttagttgttaagttctttataaagttgaggaagttcccctctattccaagtttgctgagttgtttttactatgaatgggagttgggttttgtgaaatgctttttctccatccatttaaatgatcatgtggtttttcttctttagcctgctgatattatggattgcattagtagattttcaaatgttgaaccagtcttgtatacctgatataaaccccacttgttcatagtgtatattattttctccttctctgtgagttttggcaccttgtttctttcaaggtattggtctatttggtctattttaccttttttagtggttgccctagagcttgcaatatatatttacaagtccattttgaagtaacactgcattacttcattgatagtgcaagtactttttaataacaaaatagttctaattcctcttttttctcccttgtgtctttgctatcattcatttcatatgtacataaactataatcattgaatatattgttagtattcttactttgaacaaacttaactgattaattaagaataaaataataaaagtttttataatagctttacttattccttttctgatcaagaagaaattcttcttcctttctttatgtagatctgagtttctgagctgtatagttttccttttccctgaagaactttttttgaaaaacgtttctgacaagctagatctacttacaacaaattccttcaatttgtttttgtctgagaaagagtatttctcctttagttttgaaggatgattttgcaggtacagaattctaggtttttttttttcctctctctctaaaaactcttaagtatttcagtcttcttgcttgcatgttttctgagatgtcagatataattatctttactcctctatggtaaggtgtttttttctccactgggcggtttctttgaagattttttcctgtatctttgattttctgcaggctgagtaggatatgcctaggtgtagttttgtttgtttgttttggcatttatattgtttggtgttctcttagcttcctgaatttgtagtttggtgtctgacattaatttggggaaaattctccatcattattgcttcaaatactacttttccattttttctcctctgttattccagttacatgcatgttacaccttttatggttgcacggttcttcaatattctgttctttttttttttttttttgagatggggtctcactctgttgcccaggctggagtacagtggcacgatctcagttcactgcaacctctgcctcccaggttcaagcgattctctgcctcagcctcctgagtagctgggattacaggcgcctgccaccacacccagctaatttgtgtatttttagtagagacgaggttttaccatcttggccaggctggtcttgaactcctgacctcgtgatccacctgccacaacctcccaaagtggtgggattacaggcgtgagccaccgcgcctggccggttgttgttgttgttctttttttttttttagtcatttctctttgatttttagttttgagagtttttattgacatatcctcaagttcagagattcttttcctcagctgtgtccagtgtacagagtctatcaaagtcattcttcattgctgttgtagtgttttagatctttagcatttgtttttgattctttctgcatctctgcttacattacacatgtatttttgcatattgtctacttttttccttagagcccttagtatgttaatcaaatcggagttattttaaatttccagtgtgataatttcaacacccatgacatatctgtctggtactgatgcttgctatttctcttcaagcaatgttttttactttttaaaatgccttgtaattttttttttttttttgaaagccagacatgatgtattgagtaaaaggaacttcggtacacaggcctttagtgatgtggtggtaagatgtatggtaagtggaaatgttctgtatacctacgattaattcttagcctgtgctcctgggctgcgaactttgcaactgcttctcagtcttctctatcctccacttatatgggatatgatggctagagggggctgagttgggtagttcctttaccccaagagaaaggctagaggggcaggtaatgggtatttccctttctccaggtcagttaggctctaattaagtagtttgtcttgagtggaggccttgatatgaacagaatgctgttatgtatttcaaaatggttgtatgttcttcccctgctggaagtgagacaggaaaagttcccttgttcccctcgcagggcacgcgatgagggtgtggattgcttcttcagtgcctgctggctcaaaactctaggtggagcatgcagtcaggcaggctgcggggctctgaccccacggcagtgtctagggttgaattttgtttttgttttttgagatggagactcactctgttgcccaggctggagtgtagtggtgcgatctcggatcattgcaacccccgcctcccaggttcaggcgattctcctgctcagcctcccaaatagctgggattacaggcgtgtgccaccatgcctggctaatttttgtatttttagtagagacaggatttcaccatgttggtcaggctggccttgaactcctgacctcgtgatccacctgccccagcctcccaaagtgctgggattacaggcaggagccactgcacccggccctctaggagtgaatgtttacagctgaagccccagtgggcatttgttacagggtgctcttttagtttagccgtccataggtagcttgtgttagtcagcacaattaaaccccctgccttatggcaaggacagagaactttctgtatcctggggttcttgccttgttgtactggaagaattggatcacacgtgggcttgagtgcaaggttttattgagtggaagtagctccaacagatagggttgccagaagagatagggttttcccctggcgttaggctgcttggttgcccaggctctcctccgactgcccaggccaaactccacgtcattcaaccggtcatttgatggcctgccagcatctgttggtgtgctcttccactggcatcctccccttgacgtcctcttgacgtccagccgcttgtgtcttctgctgctgctgtgttcctttcaacgtccagctgcttgtgtctctgcctgctagggtcttggggttttttttgtttgattgagatggagccttgctctgtcatccaggctggagtgcagtggtgcgatctcggctcaccacaacctccacctccccagttcaagcgattctcctgtctcagcctcttgagtagctggaattacaggcacctgccactaggcctggctaatattttttcttttttgtgtgtatttttagtagagtcagggtttcaccatgttggccaggctggtcttgaactcctgacctcaggtgttccacccacctcggcctcccaaagtgctgagattacaggcgtgagccattgcgcctggcacattacttctttaagtgtggttttctttagttctctgaacatgtttgtattagcttccttgatgtctttgtctgctgtgtttgagatctgtgcttttgcgttggcgagccccagcacaagggtagtttcagtgatttgcaaggacccacaggactggcgtataattgtactcatggatatgagttattcctgtgaaaggatacaaagcaaaatcagcgaagggaaaagatgtctggggctaaagtttgttagagccaggtgcaagcctccaagtgttctcttccaagtatggtcacacaggacatacctcatttctccaggaatgcattctgagaacacatatgaagtgttgtctactagggaagctcattagaggctcagtgaccatagcttttattgggggctggtcatgcaggcaccctttgcctagcacatagcaaaattccaggcttgcggaaggaaagcaggtgttcagcacaaaccccattgtttatacagtttagccacagtgagccattcttatcagggaatagtggcaactctcttgaaatccaggttctcagatgccagctaagggccatccttgaaggcaggcctttttaagtataacagtcttgggcctcaaatgtaaactctatatcaccttctcaaggcatttttctgttacttgctttttggtttcttatatgaatctcactttttttaaaaaatacctcatactttttgctgaaacctacaaattttagataatatattgcagtgatttctggatactgctaccccctcctctactgtggggctcattggtattgtttacttctttgtttagttatttgccagaacttatagtgttttttttgttgttgttgttttttggttttttttttttttttttttgagacggagtttttgctctgttgcccaggctggagtgcaatggcacgatctcggctcacagcaacctccgcctcctgggttcaagcgattctcctgcctcatcctccagagtagctgggattagaggtgcccgccaccatgcctggctaatttctgtatttttagtagagaggaggtttcaccgtgttggccaggttggactcgaactcttgacctcaggtgatccacccgcctcagtctcccaaagtgctaggattacaggtgtgagccaccgcgcctggctgtgatgtgttttttaacctacagtgtacatcctttggtgtccctctttagtgggacagctttgggaataagcatagtcactatggaatgattggttttagcagggctgtctttcagtgtctttttctaatttctctgttaatctgtcagcctctgttatctcacctaatcattagtttgcactaatttcagactgattactctattggttttgaccatgtccaggggcataaattgcctaactatgtgatccaaatttgggcccttttatagagatagtatttgagaccaacctttgaggttggctcagatcccaggtaggctcttatttgtctttttctctgggtctctggctgtcttctagctggtgtttctatagcttgttgctctcaagtagttactaatcttctcttaatagcttaccacccaaatctctattgttattgggaacatccttaggcttttttttctccccattgtgttccaaattaagtcatttattttggggataccttcagaactctgttattgcagcctgcctttcccctcgggcaaaacctctgcattgctgctctggagctgagggcaaggaaactgtctcagttttccctgtgacgcaagcaaggtgtttggcaggggaagatggcctctggttttcctaaatgtcaccctaaggttaagtcttccctttgtgctatgtctcagagaatgtttccacattattgtttctttctcagtagtggtcctcttggtgttgctatatgacatttttagcctggtcactggttggcaggagtgtgccctatctgttgttttattaattaaggcttagttttaggcaccagtgtcctggggtctcgtggttgtgttatactcagtactcctgcctcttcctcctgctgtaattttggacccattgtgtatttctgctctttcttcatagctaattttttttttctctctatttcattctcccagggtcacagtttttacaactatcctaatggccacagtgtttgttgcccttcctcccactgagtaaggactttgttttgtagatggagtaggatctgaacagatttctttgaccttcccaaaacagattttgttcccctctcccaggtgtgtaccttgagggtagtttctcaagactgtcatcaatcttttgtgtgatctcttgaatgggttagtggagaaaatacctgaatagtctgcagacctctcaattctgtgctgccccaccctgggcttcatacttacttgccagttaacacttaccctttgccaattgaccaaccattttagttgatctcttactgatgtctggttgcatctactttcacaggtaagccgggggtgtgtctcatcattcctttggggcaccacaacttagattttggttggccccagtaagactcctgtctctgggggattcaaggaaagttgtgaacttctttcctattctcctaccctctttatttgtaagggtgaaagtgatgctctctctagctctctacctaccagaaccagatgatgttttctagtctagtctggtactgtctttcacttactgtgaagccccattatatttactgtgattttcttcatattgttggatttatatctctaatttaaaaaaatgatttggtttggaatggttttttcataatgcaatccaaagtatcatagtccccatggtttcttagtctttccctgtttctcatgaccttgacagatttaaaaagtgtactggttaggtatttggtagaatatttctcaatttggatttgtctgatatagtctcatgattaaatgatatgaattttggggaagaataccacacagatataccattctcatagcttcatatcaggatatatatgtatacatacacacacacatatacacacatatacatacatgtatacatatacgcacatatatacatatatacatatacacacgtagacatgtatacatatacacacgtagacatgtatacacatacacacgtagacatgtatacacacgtagacatgtatacacatacacacgtagacatgtatacacacacgtagacataaatgcatgcatatacacacgtagacataaatgcatgcatatacacgcgtatacatatatgcgtgcatatacgcacgtatacatatatgcgtgcatatacgcacgtatacatatatgcgtgcatatacgcacgtatacatatatgtgtgcatatacgcacgtatacctatatgtatgcatatacacatgtatacatatatacacacatatatgtatacatacatatatatatatatatatacacgattttagcattacttattactgaggatgttactcttaatcacttagttcaggttgcccggtttctccactgtaaagttactgtttttctgtttccatcctctatgctttggaagtgagttactaaatttagtccacatttaagggaagcagaattaacctccatatctggaggggtatctacctgtatatatgtatttatttttgggaaattttctctaaggaagattttttttctctcccttatttatttggtcatctgtttctatcattctggattcgtgaataattattaatttgttaattatacataatcccacatcttttttttggagctattgcttactttctggtacaaggtagtataggcttatcttgtattctccctgcaccagccttacttttagccattttaataaggagcccgggtactttttattgaaaaatacatttagaaaccatggtctgagcactgagtgcccttttagttactgaggtagcactgattctgtacctcctaaacagaaagctagaaaatatatgtatgcatagtaatgtttggatctatttaattatttttacatacacatgtatgtagctatgtgtccattaaagtaaacatgaatgtacagtgatatctgactcttatttgagattagctctcatacttgcttattttatttatatatttattttttgagaccgagtcttgctctgttgcccaggctggagtgcagtggcatgatctcggctcactgcaacctctgcctcccgggttcaagtgactcttctgcctcagcctcccaagtagctgggattacaggtgcccatcaccacacccagctaattttttttgttttttttttttttttgagacagaatcttgctccgtcgcccaggctggagtgcagtggtgcaatctcggctcactgcaacctctgcctcctgggttcaagcgattctcctgcttcagtgtcccgagtagctgggattacaggcatgcgccacgacgcaagaaaatcacttgaacacaggaggtggaagttgcagtgagccaagattgcaccactgcactccagcctgggcaactgagcaagactctgtctccaaaaaaaaaaaaaaaacaaaacagtctgggtgctgtggctcacacctgtaatcccagcgctttgggaggccgaggtgggcagatcatgaggtcaggagatcgagaccagcctggccaacgtggtgaaacctcgtctctactaaaaatacaaaaaattagccaggcatagtggtgcgcacctgtaatcccagctacttgagaggctgaggcaggagaatcgcttgtacccaggaggcggaggttgcagtgagcagagatcgcaccattgcactccagcctgggtgacagagcaagacttagtctcaaaacaacaacaacaacaacaaaacttctttctctaatagtaagaaaactgagtcctgttatctatatttacttgtttgttctactttactatacatttaaagtggttttataactgcctaagttcctgtaaaaattttatcagttagcattaatattgtacctttattacagtttctaaaaatgctcaagtgttttcacattattccttgtagatgtcatatagtttatctttttacctttaggtccatgatccattttaattaatatttgaatgagcgaggtaatatgttgtcactttttttggtatgtggtcctctagttgtttcagcaccttttgttaaagagattgcaggccatgcacagtagctcacgcctgcaatcccagcactttgggaggccgaggccggcggatcacgaagtcaggagttcgagaccagcttggccaatatggtgaaaccccgtctctactaaaaatacaaaaatcagccaagtgtggtggcaggcgcctgtagtcccagctactcgggagtctgaggcaggagaatcgcttgaactcgggaagcggaggttgaagtaagtcgagatggtgccactgcactccagcctgggcgacagagcgagacttggtctcaaaaagagcttatctttcctatattgtatggtttttgcatttgtgttgaaaataactagatttgcatggtatttttccggactgcttattcttttccattgatatttgtatttattgtttctccaataccacatggtattactaagtatttattttaagtctataaatgaggtagtatgaactttcaaccttttttatttttcatgattgttttcgctaatttctttgctttttaacttaaatttttgaataaatttggcaatagctacaagaagacgttgctgaaattttggttggtatgttattgaatctattagatgaaattggagagcatttgtacctcactgagtctcctgattcatgaacctagtatttcctatttatccagatcttttttcatttatttcatcaatgttttgtagttttcagcctataaatcctgacatattttgttagatttaacaaatgatgtaagaacttcattttgggggtgctgtgattaaaattgtgttgtttgtatttttttcatttcaaattccagttatttatagctgctgttatgtgaacatgattgatttttgtttattggccttgtgttctgcaaccttgttcaactcaccatttttgttctaaaaggttttttgtttttttttgtttttgttttttgagatggagtctcgcgctgttgcccaggctggagtgcagtggcacgatctctgctcactgcatcctccgcctcccaagttcaagcgattctccggcctcagcctcccaagtagctgggagtacaggcacccgccaccacgcccagctatttttttgtatttttagtagagacggaatctcactatgttggccaggctggtcttgaactcctgaccttgtgatctgcccccccccccccccccccgcctcccaaagtgctggattacaggcgtgaaccaccgtgcccagcctaaaaggtttttttaaatatagattatttgatattttccagacacacaattgttttctgcaagtaagagtctttttttatttcttcctttgcaatgtatgtgccctataattgtttttctggctttataggccttctaatacaatgttgaatagggcagggtgggagggcatactttactagtagttttccactctgcatgttacctgtaggtctttcatagatgccctttattaggttaagcacctccattctatttttagttttctgggagtttttattttgaaaatatgttgaatttgccaaatgcgttttcctgtattgacatgattgtgcggtcttcattaaattattgatactgaattttatttattgattgtttttaaatgttgaaccaactttgcattccttgtatgaaacccagctgattgtgatgtattattattttttttttttttgagacggaatcttgctctgtcacccaggctggagtgcagtggcactatctcgctcactgcaagctccgcctcctgggttcacgccattctcctgcctcagcctcccgagtagctgggactacaggtgcccgccaccatgcccggctaattattttttgtatttttagtgagatggggtttcaccgtgtcagccaggatggtctcgatctcctgacctcgtgatccacccgccttggcctcccaaagtgctgggattacaggcatgagccaccatgcctggcctatcatttttttatattgctggatttgatttgtaaatattttgttgacaagtttctatttatgcccattagattgacttgtagtttcctatttaaattttttttaaacactgtgtatattatatatttggggcacagtgtgatattttgatatatgtttatatcatggaatgattgaatcagcctaattaaatccattacctcacatacttaccagttttttaatggtgaaaacaattaaaatctaatctattagcaattatgaaaaatgcagtacattattatttattatactcaccattgtgtgcagtagatcaacatctcccctttccccgtccacctcacttttccagtcactggtaaccactattctactctatgtctatgagtttgactttcttagattctacatataagtgagatcttgtggtatttgtcttttggtgcctggcttttttcactcacatgatgtcctccaggtttatccatgttgtcacaaataacaggatttccttcttttttaaggctgaatagtattctgttatgtacgtatatcatattttctttattcatttatctgatgatggacatgtaagttgctcctatatcttagctattgcaaataatgatgtaatgaacacaagagtgcagatatctctttgacatactgatttcaattcctttggatatgtacccaaaagggagattgttgaattatctgtaaatttatttttagttttttgaggaacctgtactgttttccataatggctatattaattgacattcttcaccaactgcacaaggattcccttttgtacacaacctcaccaacacttaacatcttttttgtttttggtaatagccatgctaacaggtatgaggtgatacttcattgtggttttaatttgcaagtgataatgaacagtttttcatatgtccattgaccatttgtatgttttcttttgagaaatgtatgtttaggtcccttgcccatttttaaattgggttcttggttttcttgctattgaattgttggagttccatatattttgaatattagctcattatttcatatgtgatttgcaaatattttatcccagtttgtgggttgttgctttactcaattgtttcctttgctgtgtagttaactttttagtttgatgcaatcccattttaaattaaaatttttgttttagttgtctgtgcttttggaggtcatatttatgaaatctttgcacagaccaatgttgtggagcattttccctatgttttattctagtagttttacagtttctggtctaatgtctttaattcattttgagttcttttctgtatatggtatgagacaaaggtctgatttgattcttctatatgtggatatacaactttcccaacaccatttactgaagaggctgtcctttctccattgtacgttcttggtacctttgtcaaaagccactttaacgtaaatgtctgggtttatttgtaattctcatttgttgtaatgtttttctctgcttttgtgatcagggtaatgctagcctcgtaattggaatatgttttctccccttctatttaatgaactaattgtgtagaattgatattgtttcttccttgattgtttggtagaatccaccattgaaaccatgtaggcctacagtttttatctttaggaggtttataactttcaatttaacttatttactagaaatagagctattcaggttttcttggcaaattttggtagtctgtgtctttcacataatcattccatttcatgtaacttagcaaattcataggcatagaattgtattccttcattatcctcttaatgtctttggcatcattttatggtactgatgatttatatcttctctatttctgtgagcctggctagaggttgttcagttttgtcagtgttgtcaaataatcagctttttttttttttttttttgagacagagtcttgctcttgtcgcccaggctggagtgcaatggcatgatctcggctcactgcaacctccacctcctgggttcaagcgattcttctgcctcagcctccggagtagctgggattacaggcgcccgccaccacacccggctaatttttgtatttttagtagagatggggtttcgccatgttggccaggctggtctcgaactcctgacctcaggtgatccacctgccttggcctcccaaagtgctgggattacaggcatgagccaccgtgcccagcctcagcttttggttttattgatttctttcttttgtatgtttctgttttttcgttttttgttttggattcctgctctcaatgtttattattccctttcttcatcttgctttatatttactttgctcttctttctctggttcctttgagacaaactttggttactgactttagatattattttttaatgtatatattgaatgctataaacttccctgttaacactgctttgtctgcatcctatatgttttgatatattgtatttatattgttctttagttcaatccatgttttaatttctcatgagactttgtttgttacctatgtgttatttgaaagtttcttgtttcatatccaattgtttgagggaattttccagatttttttttttcatttctaatttgtatgatctcaggatgcaccttgtatttttttctatgtttaaataattaattgaggtttatttaataagccaaaacatgatctgtctttgtgaatgctacatataattgagaagaatatgtattctgttgttgcttaaagtgttctatcattatatgaagttgtttgatagtaatgttcaggccttccatatcatttgtgattttttacttgttttattaatttcttagcagtgttcaaatctcaaactaattttagatatgcctacttgttttttcatacctcatttattgtcttattcattttgaaaacctttgattaggtgcgtatacctataagattattatgtgttcttggggaaataactgtcttttcatgaggtttctctttatcctttgataatctttcctgttctgatgtctattttgtttcatattaataaatattttcaacctatttctttggttagtgttttatgctgtatctttctccacccttgtacttttaatcattgtatgcctttatagtttgtgtatgtatgtatttcacagtaagtaggtgggtggttgggtttttaggtaggtaagtaggctaaatagataggtgggttggcttgtgttttattccatgtgacagtgttcatccttttactggtggtgtttagaccattacaatttaaaaaaaaactttatttgggcaaaacttatataatttactcattttaagggtacaattaaattatttttagtaaatttagtgagttctgcaactaacaccattattccagttttgtaatgtttttaccaccccagtaacatttttcataccactttacagttaacctttgttcccatcctcacccccaggcaaatactaatctactttcatctatgttgatttgccctttctggaccttccatacaattagaatcatataacatatagtattttatgtctcagttcttttacatgggttaattattttgaggtttgtctatattattatatgtatcagcctttcatttagtttatttgtaaataatattcaattgtgtcaatatgtctcattttctttctccattaaacacttgatgggaatttaagtagtttctgtgttttggcaattatcaattatgcgtctgttgacattcatgtggaaatatttaagcggacgtgctttcatttctcttatgtaggattttttggataatatggtaatttgactttttaagaatctggcaaactcttttccaaagtgactgtactacattacattcctatcagcaatatatgagggttagtgattttctacatatttgtctacatttattactgtcttttattaaaaccatttttgtgaaagtaaaattatctcattgtggttttattgcatttccttaatgactaatggagtaggaaatatttcatgttcttattagccattcttctttggtgaaatgtgtatttaaatcttttgcataatttttaaatctggcaatagaagttgtccaaatctgtacttttgtctgttcagggtcttttgcatttttatgtgaattttagaataaacttgttaatttctgaaaaaagcctgctgttattttgatagggaatgtaatgaatctatatagattagttttgggagaattaccatcttagctataataacgcatcttttttttttttttttttcttctgagatggattcttgctctgttacccaggctggagtacagtggcacgatcttgactcactgcaaatcccacctcccgggttcaagcaattctcctgcttcagcctcccgagtagctgggattactggtgcccatcactgcacccagctcatttttttgtacttttagtggagacagggttttaccatgttggccaggctggtcttgaactcctgacctcatgatccacccgcctcggcctcccaaagtgctgggattacagacgtgagccactgcgcccagccaataacgcatcttaaacatgaaatatctccccatttattttggtcttttaaaattttcttcaacaacattgtgtagctttctttatacaaatcttgcaggtgttttgttgaattattcctaaagatttagtctttttggtgctattttgtatggaattgatttcttaatttcatttttggatcattcattgctagtatgaaaacagaacaatttattatataggttttttgtttttttttttttttttagatggagtttttgctcttgttgcccaggctggagtgcagtggtggatattggctcactgcaacctctgtcttctgggttcaagcaattctcctgccttctgagtagctaagtattacaggcgcccaccaccacgcctggctaatttttttgtatttttagtagagatgggatttcatcacgttggccaggctggtcttgaactgctgacctcaggtgatccacccacctcagccttccaaagtgctgggattacaggtgtgagccaccgcacccagcctataggtttgtattctacagccaactcttctcagaggaagtatagatagatatgtatactaacccatgtatagctacatatttatacacatttttatatgtaactatcgatttttttaagttaaatgtgagttcatactggtatttctaactaatccattaccacatggttaattctagtcatatctccttgtttgtctgtcctcactctctcactccaataggaaagagcctgtctcctaacatttaccattcatttacataattgtactatcccattatacaggtataactgtttcagaattgttgatttttacccttactggaaacaactctatcaactggagtataatgcttatgtatagcttcttttgcatttagtcttacagactccacttattaatggtgagagactggacatactgctcagatcgggaacaatgcaaagatgtcctctctcaccactcctaatacaagaaaaggaaatatagactggaagggaaaaaataaatctttatttgtagattataagattgtctacatagacgtttttagagcatctccagaaacctagaactaacaaatgggagtaagaaggacacaaggtattacagttacttttcattttctgttagttttggcatctcatatttaagtctggttttcaagattgcattcttttcagatggtatttttttctttgtttttgtatacattataatgttgagagtcaaacatataaagtagtagatactgaggtatatatatgtattttctttgcgataagcacacctttccttcatctaggctattagcgtggaggtttttgtgaaattagtcaggagttggtctgggattgaagttttgttgttaccatggttactctctgtgtatcagaaacttcaaaccctataatgataccttgtttttgtgtccttgtttggcgtgggttttcaccttttcactcttctctagagaaggcctgtggttttcagctttcccctgtgcattactttaattttatttgatgtttagtctgtggttggggcgaaaaagaggcatgttctctaatgttctaatttaaactcagtcttaagtaggcactgtgaatctgggtcttgtgggtgtggctgtcataagtctttcttttccagtcaatgcctagtatttattcccattcctcccctatggctaaagctttatgtgttccttacctccttacccagcccctgttgcttccactccagggtgtccctgcaaattgctctaaggtttttgcttcttaggcgagataggagacgggcctctggggaattttggtctgctttatattcccttccactgcttcatgatcttttctgtaaatgaagaactttttttggtggggcgtggtggttcacgcctgtaatcccatcactttgggaggccgaggcgggcggatcacctgaggtcaggagtttgagaccagcctgaccaacatggagaaaccctgtctctacttaaaatacaaaattagctgggtgtggtggtgcatgcctgtaatcccagctactcagaaggctgaggcaggagagtcacttgaacccgggaggtggaggttgcggtgagccgagatcgcgccattgcactccagcctgggcaacaagagcgaaactttttttttttttaagaaaggtagattggggcagattttcagccatagctgctactcctttcccccagatagtaccaaaggggtctttctctgtgatctctgatctttcctgtggcttcctattgataacagctgcaggtggctgcaaccccacccccatatttgaaacctgaggggattcctattctcaggccagcccacacttggcctttagcaatttattgtaatttctagttaaatctttctacctgcttttatattgattttcatggcatttgtcccagtaatcaaatgctcagattctgttttcccctgcaggcacctaccatttttttagatttctgtatttttttttttcctgtaacttcagttctctgatagggtcaagaaaatcataactttgcttttgtcaagccttttctaagtgaggtagtgatgttgtttctagtgccctatatatttgagatttgttgtctttgttatttttgtttatttctgtttcttattttttcttctgtatcatttgaacattttttagtattttattttatttatttatttttttttgagatggagtttcgctcttgtcgcccaggctggaatgcagtggtgtgatcccagctcactgcaacctccgcctcccgggttcaagcgattctcctgcctcagactcccaagtagctggggttacaggtgcccgccactatgcctggctcattatttttatgttcagtagagacggggtttcaccatgttggtcaggcttgttttgaactcctgacctcaggtgatccacctgccttggcctcccaaagtgctgggattacaggcgtgagccaccgcgcccaggctttaatattccattttaattatctttatttatttatttattttgagacagagtctcgctctgttgctcaggctggagtgcaaatggcacaatctcagctcactgcaacccccgcctcctgggttcaagcacttcttctgcctcaggctcatgagtagctgagactaactacaggtgcatgccatcacgcccagctaatttttgtattttcagtagaggcagggttttgctatgttggccagggtagtctcgaactcctgacctcaggtaatctgcctgcctcggcctcccaaagtgctgggattataggcatgagccaccgtgcccggtcttaattatcttttatacattcgaattgtctcataaatacatatctaacagtttatgtagattcagtgttttaccacttcaggtaaaacatagaagccttacatccatataaagctctttatactccctcactgattctttaagtagttgccatgtgttttacatttgcattgtgtttctgctttcaggagtcatacatattttaaagaacttaagaggagaaaaatagtcttttatatttactcagtaatttaccacttcttttttttttttttaaaccagttctttgttctctcatttttaaagatctaagctttccctgggtatcatttcccttcagactaaagaactccctttatcatttaatcagcactctgcttgaggtgaattgtcttaatttcccttcatctaggaatgtgttcatttcaccttcattcctgaaagacattttcaatcactggatatagaattgttaattgatgggatttttttcttgttgctctttaaagttatttttctactactgtccttcatcgtttctgataaaaaatttgccgtcgtttgaatcattgcttcctcagatgtaatgtgctgtttttttaatagctgctttcaaattttttcctttgtctttgattttcaacagtttatagtatttctgggtgtgtcttttcagtttatattgtttggttttgctgaagttgtttaatatgtagatttatcttttatcagattgggaagtttttggctgttatttctacaaactttttttctgcatgatttttttttctcattctgagactatgatgacatgtatattagatattgtgatattgttccataggtcctgaggtgctgtttgttctgtttcaatctattttttatttatttatttattttattattttttttgagacggagtcttgctctgtcgcccaggctggagtgcagtggcatgatctcagcttactgcaagctccgcctctcgggttcacgccattctcctgcctcagcctcccaagtagctgggagtacaggcacctgccaccatgcccagctaatttttttgtatttttagtagagacggggtttcaccatgttagccaggatggtcttgatctcctgacctcgtgatccgcccgcctcagcctcccaaagtgctgggattacaggcttgagccaccgcgcctggctcaatctattttttaattctatttttcagattgggtaatttctgttgatctgtcttcaaattctgtttcatgttcctggctgcattctgttattgagatcttcagtggatattttttattgtgaatgttgtatgttttcattaaaaaaactcaatttggttctttaagtgttattaaggtataatatcataccataaaattatctattgtaagtatacaattcacctagttttagtaaacttatggcttgaagttgtcatcataatccagtttagaacatttcattatttccaaaagtttcctcaagtcacttctgctcccatcccaggctaccgtgatatcctctgtctgtaagtttaccctttctagacatttcatgtaaatgaaatcgtacgatatttattccgttgaatctgacctccttcatttattaaaatgtttctgagatttagtcatgtggtagcattaataagtatttcattcctttttagagctgaatgttgttcagttttactaatgtcacattttgtttctccatgcagcacttgactgaaagttggattgtttcctttttttggtggtgggggggggctattatgatgaataaacattgctgtgaacattaatgtaaatgtcctagtatattttcttttctattctgtagattctttggaatagaatagctgggttgtacagcaaatatttattcagcttttaaagaaactaccaaactgatttccaatgtggatatactattttacattttcaccagcaatgtatgagttaacatttctccacatcatcacttgttattacctgattatagccattctaattggtgtgaagtagtatctcattatgattttgttttgcattttcttaaactgtatgagattgagcatcttttcatttgcttattggtcatttgtatgtctttgatgaaatatctatttaaatcttttctccatttaaagttattttcttattgcattgtaagagttctttatatgtattttgtactcaagtgttttatcagaaatatgatttacatattttttctcagtctgtagcttgtctttttattttcttaatggtgtcatttgaagtgctaaaatttttaattttcgtgaagtccattacatcagttattttctgtgtctcatttttcataagttttatactctgttgattagttttaaagtaagttttaaagttgggtagtgacagatctcctactttgttgtttttcaaaattatttcaggtgatccacattctttgcatttaaaatgagcttgcaattttctacaaaaaaagccttctgggattttgatagggattgtattgaatttatagatcaacatgatgagacgtgccttcataattatatattgcattgtcaaatccatgaacaaggattttcatatattttcatccatttatatatctacttcaatttctccatgcaatattttgcagtttttaatgtataaatctttctcttcttttgttaaatttattcttaagtattttactctttttgatgctattcagaatagagttctcttaatttcagtttattgctagtatatagatatatagttgattttaatcttgtatccgattacttccttaaactttgttatagtagttttactgtgaaattcttaggttaagaataaggatttcataatagaactacaaataggatcatttcatatgcaaataaggacaattttatttcttctccaatctcattgtctttaattttttttccttatttactgcctagaactcctagtacagcgttgactagaagtggtgagaaagctggcacagtggctcatgcaagtaatcccagcgctttgggaggccagggcgggtggatcgcttgagtccaggagttcaagactaccctgggcaacatggcgaaaccctgtctctacaaaaaaaaaatatatagtagccaggcatggtggcatgcgcctgtagtcccagctgccagggaggctgaggtgggaggattacttgagtctgggaagtcaaggctgcagtgagccatgattgtgccactgcactccagcctgggcaacagagaccccgtctcaaagaaaaacaaacaactccccccccaccacacacaaaaggagtggtgagaatgggaatctatgtcttattcccatcttctggagaaagtaaagcattaagtctttctccattaagaatgacgttagttataggtttttgttattgttgtcttataggtttcttttgttagattaagtaagttctttttcattctcacttttaggagagttttaaagccttgaatgggttttcagtttagtcaaatgctatttttatgtccatcgaggtgataatatatatattttaaatgtaatatattgaactgcattgattgaattttgagttatgaaacaggcctacattttatgataaaccctactttctcatgatataatttatccaatttgcatattgttggattagatttcctaatattttgttaagaattgttgcatttgagtcaacttaggtacccaaatggttggctagataaaatgtggtatatttatatcatgtaatactatacagccataaaaaatgaaaccatgtcctttgcagcaacatggatatagctggagacctttatcctaagcatattaatgcaggaacggaaaagcaaataccccatgttctcccttattcatgagaactaaacatgagtacacatgttcacataaatgtctaatgtgaacaatagacaccagggcctactcaagagagggtggtggaaggagggtgaagatcaaaaaactacctattgggtactatgctcactacctgggtgattaaataatttgtacaccaaaccccagtgacacagaatttacccatgtaacaaaactgcacatgtataccttgaaaccaaaataaaagttgaaaaaaaaaaaaaaaccacccatggattgttgcatttatcttcatgaggaagattggaatgtgatttccttttcttataatgtctttatgaggttttagtatcacggtgtttatggccacattaaaatgagtaggacagtaagtaatacctcttcagttttctgtaatgatttttttagaatccatattttattttattttatttttttgagacggagtcttgctttgttgcccaagctggagtgcagtggcgtgatctcggctcactgcaacctctgccgcctcgtttcaagcgattctccctgcctcagtctcccaagtagctgggattgctggtgtgcgccaccacatccagctaattttttttgtatgtttagtagagatggggtttcaccatgttggccaggctggtctggaactcctgacctcagatcatccgcccacctcgacctcccaaagtgctgggattacaggtgtgagccactgcatccggcctagaatccatattttttaatccttgaatgttttggtagaattcacttgtgaatttatcagtgaaacagcttggtctgttgttttccttatggaagttttaaaattactaattctatgtcattaatggatatatgaatattcaggttatatgtagatatatttgttgttgttgtgttgttttgttttgttttttgagatgaagtctcgttcttgtcccccaggctggagtgcaatggcgccatctcgtctcactgcaacttccgcctcccgggttcaagcgattctcctgcctcagcctcccaagtagctgggattacaggtgcctgccaccacgcccgatttttttttttttttcttttgagacattctcactctgttgcccaggctggagtgcactgtgcaatggtgtgatcgcggctcactgcaacctccacctccggggttcaagtgattcttgagtctcagcctcccaaagtacctgggactataggtgcgcaccaccacacccggctaatttttgtatttttagtagccacagtgtttcaccatgttggccaggctggtctcaaactcctaacttcaggtgatcagcccgcctcagcttcccaaagtgttgggattataggtctgagccactgtgcccagccaggttatatattttttgaacgagctttggtagtttgtatctttttttttttttttttttttggagacagggtctcactctcttgctcagactggagtgcagtggcacgatctcggctcaccagcaccctccacctggagcgatcttggcttactggcaccctccacctcccaggctcaaatgattctcctacctcagcctcccgagtacctgggattacaagtgcacaccattaccacccagctaatttttgtatttttagtagagacagagttttgctatgttgaccaggctggtcttgaactcctgacctcaaatgatctacctgcctcggcctcccaaagtgctgggattacaggtgtgagccaccgcacccggcctctatattctttggtagtttgtatcttaaggaattaaaagataaaaggtggataagaaaagattactaaggaagttatttcatcgatttttggtttggtgtttattattttcttattttctgcttgctttttgtttaatttgttctttttctagtttcttaactccaagtcactgaattgaggtttttctttttcaaattggcattttgtgctgtttttttctacatacgttttttggtgtcaccccacatattctgacattttcattttgattctgttcaatatactttctgatttccctcttgatttctttttggtcctggaatgtgctatttagtttatgtatatttagggatatttcagagatgtttctgtgactgttacctattttaattctcatatggtcaaagaatatactttgtatgaattacattttttaaaaattggttcaagattgttttatgacccagaatgtggtatgtcttggtaaatgttcagtgtcttctttaaaaaatgtgtgttctgccattgttgactgaagagttataaaatatcagctaggtcaagtaagtcatttgagttttcaagtcttttatatccttagtgatttttctatccacttctgtcatttatggagaaagatatattgaagtctttcaatctaattgtgaattagtctgtttttccttgaaattctagtaattcttgcttaatttattttgaagctctgcatagacttttaacactgttaagtctatcttaacttctttgtcattatgaaatggtcttcatccatggtagtattctttgttcagaaatctgctttgtctgcccaaggggtctttggtctgtaggaaattaacccatgaaggaaagaaaacttggaaaaataatttaaaaaatgattgttttttaaacataaatcatttttaaattattgattccaagggattgctgataataaatttgttcaggctgtgttaagacttgcatcttttttttttttttttttttttgagacagagtttcgctcttactacccaggctggagtgcaatggcgcatctcggctcactgcaacctccgcctcctgggctcaagtgattctcctgcctcagcctcctgagtagcagggattacaggcatgtgccaccacacctggctaattttgtatttttagtagagacgaggtttctccatgttggtcaggctggtctcaaacttccgacctcaggtgatccacccacctcggcctcccaaagtgctgggattacaggtgggagccaccgtgcccggccattgcatcaattttttagtaatagatgatgaaggcgagtgctaaaactgtgaagacttagaacattttaatatttctgaaaattaacttttttcagttttgaaaattacagcttctaaataaaatactgaatttttaaaaacaaaattagatttaaatatataatgtttaaagataaaaagttttatgataaaatatgccacaaacaattcgaaagatacctaacttgctttgtgtataaaaggtaaataaaggcttggctgggcatggtggctcacaggaggctgagacaacaatcacttgagcttaggagtttgagactagcctggtgggtaacatggcgaaacccaatctcgaccaaaaatacaaaaattagctgggcatggtagtgtgcgtctgtagtcccagctactcaggaggctgaggcaggaggatcccttgagcccaggaggtggaggttgctgtgagctgagatcacgccatttccagcctgggtgacagagtaaaaccctgttccaaaaaaagataaaggcttgctatttatgccatttcaaggaattagtaagaaaaatcgtagattaatgggtaaaataaatgaatagttaattcaatggcagtgcttatccaatcaataaaagacataaaaatgatactgaagtaaatgcaaatttgtagtgttagtacaagatcctttctcatctactttattgggataaaattaactggatacaactactgttggcagtgatggggaaaggttacttttatatattgcttgtgggaactgtgaattttcactttcttttttggataggtagtgctttggcctcatcagggagctcctgctttaagcacctcttcatgctttgaggccacatttgttactcagactttacaacagtggctttgagttctgccctgtttctggtacctgaggaatttcttctcatccttttggtatttcttatgtatttttattgttttgttttgttttattcagcatttctactttctgttgctttgggtgaggttttctatagcacttaagttcaccatgacgactggagcacatcacaattttttttataaccagacaagttgtcctgcaaatattaaggagactggcagatgttatcaaatataaaataactattgggattaacatctataaacccttcttgatcaaggtatttaacagtcaattatagttaaccaagaagtaaacaaaaataacactggaatagaagaaatgtgacagtgggctggtgctattcattgaatccatgtaagtattgaactagaagagcaactgagggaattaagattgcataataaaatgtttttctgaaaggtgtaggaataattattgagtgctaatcttatcatggtatggtgccaatacttactctaaagttactatgtggtaaaacattttatatatatattatatgtgtataatatatataatttatgcatataaatatattttattcaattatttttattttattaattttattttatatgtaaatatatattcatttatatacataaataaatacaaaatgttttaccctattttttattaaaaagttttttcagtggtccttttttaggtagttatatttcttgtgaaataacatttatctgaacattagtaactccttcactgtcattttgctctcattttcctgtctttatagcaagtaaaattaaatggagtaatttgaaataaattatataataaatggcattaaaataaccccattttaaaatattgaggtataatttacatacattaaaatgcatcataggtgttccatttgacaaaatagatcacattttctttactcctgaaaatttccttgtgctcctttccagtcagttctcctcttcccagtagccactttgtggtataatcccaggttcccaggttaatgaaattatttctaactgtgtttttaatacattcacatttttcttgctaaattatatgccaaaaaatgtccaataaatgttaagctttttaggatgatggcagtttgggtaattcattgctttcttatttatacttttctgtattgtgttttgttttttttttttttgagacaaggtcttgctctgtcacgcaggttggagtgcagtggcataatcatagctcactgcagcctcgacctcccaggctcaagaaatcttaccacctcagcctcccaagtagctgagattaccggcacttgctaccacatctggctaattttgtgtttttttttgtagagacagggttttgccatgtttcccaggctggtctcagggactcctgggctgaagcaatctgccagctttagcctgccaaagtgctgggattacaggtgtgagccatcatgcctggccttttttgtattatttgattttttattttaggtagtaagtcttaggttaaaaaaatcaaaacctgattattaattaaataagaaaagaatattttttaaaaaggcaaatgcttcaaagcaaaactgtcttccatcctaggaaaggtatgaaccagaaaagagcaggttcaaagagaaaaagggtatgaagtgtttcttagattagtgtttgtcataattttgagagctgatgatactaatccctgaaatagagtaaggaaaattgaaaaaaataaaagaaaaaaagagctttgtagttatatggagttggtacctttctgtttgttattatatatgaaatattgtaaatttctggcaccaccaatcataacatttaagtgtattccagagctgaatataaattattctatttttcaagttaatatatagtgttgtcagtatatgttgaatgaaattgccccttaagttttcatttacatcttatatttatctggttttactaattaatttattctgcatttttactgagtgtagcctcagtaaaaaccctaatgtgggtaggcactgaaattgttatttgaataacacatccctgtttgcagtgtgatatgaagaaggggaacagaggttcaaaaaaacagagaaagcaaatagaaaataagtaaatgggagtcttaagcaactatattgttaatgggctaaacacttcaattaaaagtcagagattatcagaatggattaaaaagcaagacccatttatatgctatcaacatgaaatttacttaaaatataaaagtacaggctgggcacggtagctcacgcctgaaatcctagcactttgggaggctgaggtgggtggatcacctgaggtcaggagttagagaccagcctggccaacatggcaaaaccccatctctactaaaaatacaaaaaatcgccaggcatggtggcgggtgcctgtaatcctagctacttgggaggctgaagcaggagaattgcttgaacccgaggggcagaggctgcagtgagccaagattgcgattgcgccactttactccagccttggcaaaagagtgaaaatccgtctcaaaaaaaaaaaaaaaaaaaaaaaagaaacccttgaaggtacagataagctgggggtggggtagtgctattaatacatacaaaatagaccataagacagagtattatcagaaataaagagggatttttcataatgttaaaagtatcaattcatcagaaagcggtagcaatcataaatttatatatgattataaacatatttttattaaaaatatataaagtggctgggcgcggtgtctcacgcctgaaatcccagcactttgggaggctgaggcgggggtggatcacctgaggtcaggagttcaagaccagcctggccaacatggcgaaacccggtctctactaaaaatacaaaagttagctgagtgtggtggtgggcgcctataatcctagctacttgggaggccaaggcaggagaattgcctgaacctgggggacggaggttgcagtgagctgagattgccccacttcacttcagcctgggcaaaatggtgaaactctatctcaaaaaaaaaaaaaaaagtatatatagcaaaaatcgacaaaattaagaggtaaaagatacttttacaattagtgctgaagatttttaccaccctactctgaccaattgatagaatttctagcaaaaaaacaaaattagtaaagacatagatgatctgaggaatactacaaaccacctcaatataattgataagtattgaacactacttccccgaattgtgaagaagatattcttatcaattgtacatcatatattcaacatagaccaaatggtggaccatgaaatatgccttgataaattttttgtgtgtgtcttgataaatttatttatttcttgagacagtctcacttgctctgtcacccaggctggagtgcaatggcgcgatcttggcttactgcaacctccgcttcctgggttcaagctattctgcatgcctcagcctcccgagtagctggtattacaggtgcatgctaccacgcctggctaatttttgtatttttagtagagacagggtttcaccatgttggccaggctggtctcaaactccagacctcaggtgatcctcccacttcagcctcccaaagtgctgggattacagatgtgagccaccatgcccagctggtaaatttaaaatgattgaaatttatatatgttctgtcaccacaatggaagtaaaattaaaatagaaattattaaaatatctaggaatgatccaaatatttggaaattagacaacacaagtttaaatgatcatgagtcaaagggaaatcacaattagaagacatttttaatcgaatggtaatgataatataatgtcaaaattcatggaatgtagctaaagcagtgcttggagggcaaattatagtttaaatgcttttattataaaggaagaaaagtctaaatgtcagtaaccaaagtttctaccttaggaagctagaacaagaacagcaaagtaaacctggagtaagtacaagtaaggaaacaatagagtaggaatcaatgatgtggaaaacagataatagagaaactttaaaaagccaaaatctggttctttggtaagatcaacaacagtaataaacccttatcttcagtgaacaagaaattgacaatgcgacatgttgtaatagtaaaggaataaagtacatagtgtggaacacagaggctgatctgaatttggttttcaaaggtggtttcagagaggtggtaaaatttgtgtttggctttcaagaattagtgtaagtttttcctgatacagattgggaaaaagaatattctgagaggaaataagagcaaaataattttatttttcaggcttttggcatatttagaaccgtatttttatttttttgagacagagtcttgctggagtccatcggtgcaatctcggctcactgtaacctctgcctactggttcaagcagttctggtgcctgagcctcccaagtagctgggattacaggcatgtgccaccactagccccagctaatttttaaatttttagtagagatggatttcttcatgttggccaggctggtctcgaactccaagtctcaagtgatccacacgccttggccccccaaagtgctaggattactggcgcgaccccacagcacctggcctagaatggtatattgactttatctgtggcatatgggttatgttaggtggagagcagtaggtgatgcaataggaaaagcagtttgagtctagagtgtacagaacctagagtaccttccttgataacttggactttattctgtgtaaaatagcaagcttagcgtctaaagtttttaaaggagttttttaaatgaaatatttcaaacagaaaatacatagaatgacatactgaacacttattaccgctaccctgctttaacaaatcttataccttactatatttgtttcagattttaagaaattaatacatcatagatacaattgaagctttgtacctttccatctcataccaccatgaagttctattctgaagtcatatatccttaccatgcatttttaaaatacttttactgtatagctatatactaataaaaaggtggcattctccatgttattaaagtttcttaaaaatgctatctatattttacttattctgcaacttgtttttctcacttattattatttttgacttatgggatattccggaagtttggactggtgtaaccacagtagttatttacggccagtgtcctttcttctttcttttttgagttaaccaggatacatttattaaatatatccaggataaatattcccaaaaacaaatatttggtaaatatggcaaacttattctttggcaaattagcttttagcatgttggactgctttccatccctattaggagtattataaggattaaatgaagtattaccaacaaaaaggtacttagcaaaattctcagtaaacattggttataatccctccaacattcagacttaagttctgcctattctctttcctcagtattctttattcctgtccatataaccattgtccttttgtaggccttcactaccttaatgtggactatagcaatagtcacttgattggtctcttggcttgttcccctccaatcttgttctctacactactgcaagggtgatctgtctaccacatagattttgaattatcatctacagtagtaaaacagttttcatggcatacaagcttcaataatttagtctagatattccgcttgatctcttttcacctcttttccatttatcttctagcaccactgcagtgcttgtagttccttaaatatgctattctttttgaaaaagcagcaaatctctgtgcagttgcctttctaactggaatatcttcccccttcttgtgttctcacaaaattcttattcatctttcaagttctagctcaaatgccacttccttgtaaaggttttcctgatttccttaagcagatttgggttacgtttctagggttctgctgctctttgtacatgcttctattataatgcttatatatattattgtagttgttttttaattttgtctgtcattctaatagactgtaatctccttgcaggaggagatctgtcttttcatcatttatataataatgactattgtacctagaatataagtcattgacatttgttgaattaaaaaaattcagaaatctatttacagccctctctactgccttcccatgacacctccattttacagatcattaagctgaagcccaatgaaatgaagctatttagtgagaactcatgcctcctaactccagatctattacttttattcttatattgtagagaatattctgtttagcatgtatatactagttatttatattataagaaacagtcttgtcagtattcttcctttcatctctagggaataggtagaagggtatagtgattttatgagatttgtgtttttttttcctgtttcaatcattcagatgcttttgttttctagcaaattcagcaaaattcaaggttttcttcatgtcattccttttctttaccctcacagaactcaggtaggattgaatgtctgatgcatttagtccagttgtcctcaaccaggggtggttttggccccctagagggcttttggcaagatgtttagaggcagttttttaaattgatacataatatttacccatatttatggggcacatgtgatattttgatacatacataccatgtgtaattggtttatctgtcacctcaaacatttatcatttctttgtattggtaacattctacatcttttagctattttgaaatatactttctgtgggtgcttcctaagcacccttacttataaccttataaccacagtacatttgtcaacctcataaatttacactgatatcatacttttgtctaaactaccttccatgttttataaaaatgttttcttaatagcatttttaacctcttcaatactggatccagtctagaagcaggtattacatttggttgtcatgtatttttagccttctgtcatctatggtgtttccacagccttgtaaaactgtagtacactatcccaaccagactattcacactgttacagtctagatacagaatggtttcatgataaggtagtgagacattttaagatatattccctgtggatttggcattcattgattacccttttccttgctcattctttaccttggttactttgcaactgtagtactcctgctagatttactagtcaggccttagcaaaatactgtaagcacaagacctcccttctcccttatttgtttagtaccatgagggactcatattcctacccttttttttttgagatggagttcgctcttgttgcccaggctggaatgcaatggcatgaccttggctcactgcaacctctgcctccccagttcaagtggttctcctgcctcagcctcccgagtagctgagattacaggtatgcgctaccacgcccggctaattttgtatttttagtagagacggggtttctccatgttggtcagactggtcttgtaggagaaatagacttcactaaaatattacagccaattagtaaaaataagacagtaaatagtaacaccttgtcctggagtgatagtagccagtattgctaccatatattactgacaatgtttaattttcaacaacaaaaataattgagagataaagagaagtaagaaaacgtgaccttatggggaagaagactggcaaaacatctcaactttgaaggcataagatgtgttactaagcagacaaatatttcaaattggccattataaatatcttaaaagaactagaggacaccatacctcaggaggcaatgatataattacaataattttgcaactagagaatataaataaataggtaagaattatagaaaagaaccatatggaaatctggagttgtaaagtataataacagaaattacaattcattagagaggtttaatactagattttaactggtagaataaacaatcattgaatttgaagatagattgatagaaatcacccagtttaaaaaatacagaataaagaagtaagtaaaatgcagtttcagagaaatggcagaagccattgagaataccaacatatgtgcagtggtagtgccagaacataaggacaacgagctgagagaaaaaatatttaaagaaataatacctgaaaattttctatattatgaaaaaaaaatccaagaagtgtaaagaatttgaagtataataattgcaaatatattcccccttagacacatcaaagtaaaattatgaaagtaaaaaaacatcttggaagcatgaagagaataatggctgatatacaaggaaactctaataatacagtaataattaaggccacagtggaggtgtatgacatattaatagtgtagaagaagtaaattcaaaattttacctgaagcacgactgacattcttaaatcaaagtaaagacattgctagataaacaaaaactgggaatgtgttcttagcagacccaccttgtaagaaaagctagtttttgagaatgaagaatactgaccccaaactgtaattgaaattcctatgaaaaatcagagtaccagtcataattatgtaataattatagaggctagtataaatgcatattttttatgtattagctggcatatatgcctatacactgtatacttataaatattcatatatgtgtattgtgtgcagtatttccatatttgtatttgtgagcttacaacatatagaaatgagatctatttaataatatcacaaagtatgtggttgagaacaaaactgttgtaataaggaaatgaatcttttttttttggagacagagtttcgctcttattgcccaggctggagtgcaatggcacgatcttggctcaccacaacctccacctctcaggttcaagcgattctcctgcctcagcctcccaagtagctgggattacaggcatgagccaccacacccggctaattttttgtatttttagtagagacaggttttctccatgttggtcaggctggtctcaaactcccaacctcaggtgatctgcctgcctgggcctcccaaagtgctgggattacaggcgtgagccaccacacctggccaggaaataattcttgatggtaactcagatccacaggggtaatataaaagaaccagaaataataagaaggataataaaatgctaaaaaaaaattttcttaccattcttctctgacctgattatataaaattatataactaagtatataattttgaggattttattgtattataataatggctgaaaagggagaagttatagagatatatagaggtataatgatttttcctttctttttttttttttttttttgagagggagtcttgctctgttgcccaggctggggtgcagtggtgtgatctcagctcactgcaatctccacctcctgggttcaagcgattctcctgtctcagcctcctgagtagctgaaattacaggcacgcaccaccaggcccagctaatttttgtatttttagtagaaaaggggtttcaccttttggccaggctgatctcgaacttctgacctcaagcaatccacccgccttggcctcccaaagtgctgggattacaggcgtgagccactgcgcccagcccatatagaggtaatatttctatattatactcatgttagtgtaaatatgaagtcgagtcctttaggatgtgtaagaaaagtcctagagagatgtcagtgacataatagaattggagctgcctcatatacactatggaatactgtgcagccataaaaaagggtgagttcatgtcctttgtagggacatggatgaagctggaaaccatcattctcagcaaactatcgcaaggacaaaaaatcaaacaccgcatgttctcactcataggtgggaattgaacaatgagaacacttggacacagggtggggaacatcacacacaggtctgtcgtggggtggggggctaggcgagggatagcattaggagatatacctaatgtaaatgacgagttagtgggtgcagcacaccaacatggcacatgtatacatatgtaacaaacctgcacattgtgcacatgtatcctagaacttaaagtataatttaaaaaaaaaaagaattggaggtacctgttttgtccctcctttcatggatacaccaagtaagtacatgcatgtggatcaattctatccaagagaaagccaaaatgtagttgaaggatgctcacacactggatgactgagaaaatatctacaacaaaatgggaaggataaactgaggtatactgatggttaaacctcaccttgagcacaggctggtataatttggaaagaatccttaactcccaccctcttcctgaggggtgacgggttgatagcacacatatagtgtcccagttcttacattctctaccagaaggcttggcccttaaatcccattatatgaggagcacaaggacttggcactagagtatttccttgaagaacagtagaatgggtggggggttgaactgcaggagcacttccaacagctgtatctcctgggatcagtataccctctagcttctcactggaaacagtttggctgcacatttctagcagcttcttgtgtttgtgtcttctatcatgcctgcacctaggagcccgtgtagcaaatgaagcataaacctcctcaagtgttaatgggagggatggcactccctacatcttccctggattgctctagtgattaatccaggtctatagtttcccttgaaagagatttgaggcctcagtgagcaaaaatggaagggtcaaaacccaccatgccttttcccagctttctccagatatgtataaccttgtaatctctccctggaaggagactgggagacagacctctcttatgctatatgtgaggaactgtacttcacctgccttcctatgtaccagtcttgttccaacaacatattggcctggagattctgtgtgaagtgagtttgtgagacttcaggaagccttaaagggagatgaatgttcttcgcaatttcttcttcagattgctccagcaataagtccaggcttccaaatccttactggcaggaggttgtgtgacttactgtgccttattgtgagattgggtacttcccatgctttcctacttggcctgctctggtgatgaattcgtttctgcagactttccctgggagtaatttgtacacatactgactgccccatattttacatccctcattcaaggtactggctcctgtatcacccagctctggagttgaaagagctcttcattcctgagtctcctgtaccactgagaataggtagttttctctcctctcctctcctctcccctcccctcccctcccctcccccccttttcttttcttttttcttttctttttttgatggagtttcactactgttgcccaggctggagtgcagtggcgcaatctcggctctctgcaaccttcacctcccgtgttcaagtgattctcctgcctcagcctcctgaatacctgagattacaagcatgcaccaccacgcccgtctaattttgtattttcactagagacggggtttctccatgttggtcaggctggtctcgaactcccgacctcaggtgatccgcccgcctcagcctcccaaagtgctgggattacaggcatgagccaccgcgtccagcaagaataggtgattttcaaacttggaaacattcagaagttatcgcctcagtttcagattgagtagtctcaaagagattacagacatctaccacaaattctctacttggtgtggtgcaaaatcagtatgatgtaaactttgtctctcagtttcttcaaaggaaagaagcaactggaacacacatataacactaacccttccagctgcattatgagggaccagtacctgtctcaaggcaaaattatgacttagttcatcctcacctctggaggccagtaaaagtgggttatagaagaacaaagaggcatctagatctttcactgggttatttggagagaaacatctcctaccgaaggccagtttaacaagactggtagaggaggttatcttatctaattcacagaaatcaacacattgagtcaagaaaaatgaaacacagaaacactctaaataaaagaagataagtcttcagaaaccaaccctaatgaaatgaagatatgtgattaacctgacaggaaattaaaaagagcaaccataaagagtctcatgggagcaatgcatgaacaaactgagaattttcataaagaaataaaagataacaaaaagtataaagttgaagaatacaataactggactcaaaaatttaatgtgtccaacagaagaatcgatgaagcagaagaaagggctatcaaacttgtagataggccattggaaatcatgtaatgtgaggagaaaaaagaaaaaagattgaagatagtttaagagacttttgagacatcctcaaaggggaataatttatacattaccagatggagaagatagagggaaaaggacagaaaacatatttgaagaaataatgtcagaaaacctcataattctggcaaggaaatagaaatttagatctaagaatctcgaacatcaggtatgatgaatccaaggagactcacaccaaaccatattgtaattaaataaaggttaaagacaatcttcagagcagcaagggaatagtctcttcttacatacaaaatgatccacggaagactgtcagcagacttcaccagaaaactttcacgccagaaggcagtcgtgatatatacaaaaagctgaaaggaaaacactgccatccaggaatactatctccaactatcctgtgtttcaaaaattaaggagaaatataaagttctcaaacaaaagatgtgggagtttaccaccactagacctgcacgggaagaattgctaaagggagtccttcaagctgtagtaaaagagtgctaattagaaacatgaaaacgtgagtataaaactcgctgataaaagtaagtacatagttggctgggtgcggtggctcacgcctgtaatcctagcagtttgggaggccgaggcaggcacatcacctgaggtcaggagttcgagaccagcctggccaacatggcacaacatcgtctttactaaaaatacaaaaattagccaggcgtggtggtatgtgcctgtaatgccagctactctggaggctgaggcaggagaatcgcttgaacctgggaggtggaggttgcactgagccgagatggcaccactgcactccagcctgggtgacagagcaagactccatctcaaaacagaaaaagtacacagtcaaactgagaatatgctaatactgtaacggtggtgtgaaaacaaattatgtatttatcataaaagttaagacaaaacttaacttgtagcaacaataatttaaattatacaaattataaaatgatataaattgtgtcatcaggaacacaatgtggggttgaaagtaaaagcatagcatttgagtaattgatctaattttagttgtattaatttaaaatagtctcataagtgtaagagactgtttaaggttcatggtaaccacaacgtttgcaaaaaacccttagtagatatgcaaaatataaaaagaaagtagatatgcaaaatataaaaaggaaaacattgaatcacataaaaaaacagcaagaaaggaagagaaaagcaaagaatttgtaatcaaccagaaaacaaattgcaaaatgacagcagaaattctttacctgtcaataagtgctttgaatgtaaatagattaaattctctaatcaaagtacataaagtggatgaatggattttgaaaagtctcatctatatgttgcctacaagacagttcatttttaaggatacatataaattgaaagtgaaaggatggacagatatgccatgtaaatggaaactaacagagagcagaggcagatctcttaatatttacatcagatgaaatagaattaaagtaaaaatttttaagcagagacagggtcattatataatgataaaaagtggtctgttcatccatggggtataaaagtcataaaggtatatgcactcaacattacagcacctaaatatataaagccaatattaaaagctttgaaggaaaatataaaatctaatacaataattgatgggacttcagcacacctctttaagcaatggtgagatcattcagacagaacatcaatgagacatcagacttaaaccacaattgaaaaccaaagttgcccatatggacctaaaagacattgatgcagtcttctgttcaacagcagtggaatacacgtttttcaaaagtgcacacagaatattctccagagtaaatcatacgttaggtcacaaaagaagtcttaagaaattttaaaagattgaagtaatattgaatatcttttctgaccataatggtatgaaactagaaatcagttataggaggaattttagaatattcacaagcacatggaaattaaataacatatcaatcagtggttcaaggaagaaattaaaagttattttcagaaaaacaaaaatggaaacacaaaataccaaaacttataatatgcaagaaaagcaattcctagagggaaattttagcaataaatgtctagaagtacaaagaagaaatagctcaaacaatttaatgttatacctaagagaactaaaagaagaacgtaacaaagattatagtataaatgagactagaaaaataatagaaaataccaacaaaactgaggggatattttgataaactaaaaaaattaagcaatgaacaataaaataagtaaaaagacagtccaatagtgagtaagaaggctgaatcaataattaaaagtttctcataaaaccaggaacttatagattcccttctgaattctacagatgtttaacccttttcccgtttgccccaaactcgctggtggcccttgtggctgtagcatttaccctgagataactttgctacaaaatatcttgctttcattattttcgtattgctctagtatattgactttggaagcaaaacacatttttctatttatagcattctgtctttagtagtggtatttccatttacaaagtatagtaactctcaatcactgaaaatgtcaaattctagaaaacatagtattcctgtgtatgatgttaatattcttgaacagttattgtccaaagatgcattgattttcttcagaaatagacaattccgatgattgtgatgttctgtttagaaataactccaagaacagtttttgtattttattttcacattgaaaatcagtcagatttgcatcagcctcaaagcgcatgtttatgtaaaatatttaagtcctggcagcgagctgccctttttttttcctaaatgggaaaagagttaaagaaaagctaatatcaatccttttcatactctttataaaagttgaagaggagggaataagttccaatcacactttatgaggccaacgttaacctgataccaaagtcagatgaagacactaaaagaatacaaaattacaggccaatatccctgatgaacatagatgcagaaacccccaacaaaataccagcaaactgaattcaacaacaaatttaaaagatcattttcccatgatcacatggggagataaccttttgcatttaaggatggttaaacatacataaatcaataaatttgatagatcacattaaagtgaacatcaaaaactacatgtctcaatacttccagaaaaagaattgacaatatttaacaaccttttttttttttttttttttcggagacagagtcttgctctgtcacccaggttggagtgtggtggcactatcttggctcactgcaacctctgcctcctgggttctcctgcctcagcctcccgagcagctgggattacaggcatctgccaccatgcctagctaacttttgtatttttagttgagacagggtttcaccatgttggctaggttggtcttgaacccctaacctcaggtgatccaccctccttgacctcccaaagtgctgggattacaggcatgagccacagtccccggcccaatacttaacatctttgcatgataaaaacctgaacaagttaggtataaaaggaagatgtctcaacacattaaaggccctatatgaccggcccagagctgaaatcttaacaccgaagagttgaaggctttttctctaagatcaggaacaagacatggatgccattttttctccttctgttcagtgttgtactggaagtcatagcaagagcatttaggcaagagaaataaaagacatctaagtaggaaaagaagaaaaaacttgcctctcctgattatcttatcttatagctagaaaaccttaaagactccattaaaaaaaaaaaaactatagaactaataaaatgaattccataaaaagtgctacgtacaaaattgacaattaagtctgtagcatttctatacactaacaaacaacaatctatccaaaaaagtaatcaggaaactaatcacatttacactatttactaagtaaacaaacttatgaatgaatttaaccaagtaggttaaagatctgtatagtgaaaacattgatgaaacgaattgaagattacaaaaatagaaatttttctttgtacatggattgggaaatttatattgttataattttcatactgccaaaagaaacatacagattctgtgtaatcaatatttcaatgtcctttttatttttattttttttacagaaatacaaaaaaaattctaaaacttgtatggaactacaaaagacattaaataatcaaagtaatcttgagcaacaaggacacagctggaggcatcactctacctgattttgtaatccattatcaaaaaactgtggtaccagcataaaaacagattcactgaccagtggaacaggaaagcccagacataactcatacatttccatccaattgatttttgacaaaagtggcacacagaatggggagaggacaaataaataaataaattgttttgagatatctgtatatctatatgtgaaattgaaccattttctcatagcatatagaaaaatcaactcaaaatggattaaagcctgaaatgttgcctttgaaactgtaaaactactagtagaaaatataggggaaaagctctatgatgttgttctgggcaatgatttcttggatacatccttaaaagcatgggcagcaaaaacagccagacaactatcagggaacctgcccagatagtcacataggttcttttctattttccctaagcattggccgggttgagaaataaagggacagagtacaaaagagagaaattttaaagctgggcatcctggggagacatcacatgtcggtaggttccgtgatgccccctgagccgtaaaaccagtaagtttttattagggattttcaaaggggagggagtatacgaataggaggtgggtcacagagatcacgtgcttcacaaggtaatagaatatcacaaggcaaatggaggcagggcgagatcacaggaccacaggactgggttgaaattaaaattgctaatgaagtttcgggcaccatcgtcattgataacatcttatcaggagacagggtttgagagcaacctgtctgaccaaaatttattaggtgggaatttcctcgtcctaataagcctgggagcgctatgggagactggggcttatttcatccctacagtctcgaccatagaagacagctacacccaagggggccattttagaggcccaccctcaggggcacattctctttctcagggatgttccttgctgagaaaaagaattcggcgatatttctcccatttgcttttgaaagaagagaaatatggctctgttccgcctggctcaccggcggtcagagtttaaggttatctctcttattccctgaacattgctgttatcctgttcttttttcaaggtgcctagatttcatattgtttaaacacacatgctctacaatttctgcacttaacacaattatcacagggtcctgaggcgacatacgtcctcctcggcttacgagatgacaggattaagagattaaaacaggcataggaaatcacaagggtattgattggggaagtgataagtgtccatgaaatcttcacaatttatgtttagagattgcagtaaagacaggcataagaaattataaaagtattaatttggggaactaataaatgtccatgaaatcttcacgatccacgttcttccgccatggcttcagccagtccctccgtttggggtccctgacttcccgcaacagacaacttgagttgcatcaaactaaaaagcatctgcactgcaaagggtacagttaacagaatgaagacacgggttttgagaaaccattttcaaatcatatatctgataaggggctaatatccaaaatgtattaagaaacccaagcccaatagcaagaaaacaactgtctttaaaagggggaaaaggacctcaacttaaatttttcagaggaagacatgagtggccaattgattgatacatgaaaaaaatgctcaacatctctaatcattagtgagttgcaaatcaaaactgcaagatattaccttacaccttttagaatggctattattaaaaggatgaaagacaggtgctggcaaggatgtggataaaaggaagtcccaacattctgttagtgggaatataaattagtatagccaatttaggaaactatatggtggttccttaagaaactaaaagtacaattactatatgatctagcaatctctacttaggtatatatccaaaggaattgaagcagtatgttgagatcttgcactcccttattttgaaattatttacaaagctaataaatggaaaagacttaagttttcataacagatgaatggacatagaagatgtgttgtatatacatattggaatattttttatccttggaaaagaaggaaaattgtcatttgtgacaacatggatgaatctgtagtatactatgctaagtgttgtaagacaggcacagagaggcaaatactacattatatttgtatgtggaatctaagaaaggctaactcatacaagtagaaagttggatgttatggtttccaggatgtgggtgttggagagatgggcaaaggcaagacgttggtcaaagagtaccaattttctgttaggaggaataagttttagacatatttcacagcatggtgaccattgtcactgactgtatattttaaaattgttataagtagatattaaagttgtcacaacaaaagtaggtgaagttatggatatgttaatgtgcttgatttagttattacactatgtatacatacaaaaacatcagatagttccctggaattatatacaattattacttgtcaattataaaaaaaagccctactgcaaccactaaaaaggattttcatataatagagggaaaaatcgttaaagataataatacattattttagaaaatattaacttataaaaagtagtataggagggattctgtaaaagaagatagacatagaattttaaaatgtataatggaaaatttaaatccagctgtactgatggatcaagcaatccaaaccagtctgattgaccaagtggatatttaaaaaacaatcaaactataaggtgtctgttgtaggcagtttataaaatacaaaagtgttgaaagaaataggatggaaatagaaatatccaagtagcaaccacaaaaaaactggaatgtctgcactaacatcatacaaaacaaaccaaatgaaggttaaaaatattgaaattatacaaaatatgttctatgactaaaatttaatgaaattagaaataacacagagataggaactatacatatttgtgcaaatttaaaaagttatgctgagtgtggtggctcacacctgtaatcccagcactttgggaggccggggagggtggatcacttgaagtcaggagttggagaccagcctggccaacatggtgaaaccctgtctctactaaaaatacagaaaattagccagatgtggtggtgtgcgcctgtagtcccagctactcgggtggctgaggcactagaatcacttgagcctaggaggcagaggtggcagtgagccgagatcacaccactgcactgcagcctgggcgacaaagactgtcaaaaaaaaaaaaaaaaaaaaaaagttacgtaaccaacaagtcaaaggagaatttataaggaaatcagaaaatactttgaggtgaatgaaaatacagaaacaacatatcaaattctgtgagatgtgtgaaagcaacgcttacagtgaaattaatagctatgaacattgtaatgaaatgagaagtacttcaaattactaacctaactttccaactttagaaaatacagtaaaaaaagaacaaattaaaatcaaagcagaaaggatataaagtttagtgtggaaatagagaattaaaaataattgagaaacacagcacttcgttgacttattcataaaataaagctttattaaaatgagaaatgtaaaacgtgatgttcctaatgaccttattccatacaagggattagtattttgacaaatatctttgtggaagtagacaaattcctagaaagacactgactaccacaactcattcaagaacaaagtgaagacaataaattggtaatttaaaaactctcacccctgcccctgacacacatgtaaattcccagttcaaatgtattcttttgtatattataccaaacacatgaaaattaccaattcgataaaaatgtcttaaaaacttggaagagcatgtaatattttttactggttctatgatgctattgttatctagataccaaagtgaaacatcatacacagggaaaactctgataatatcgcttatgagtggatctgtgaaatttcctagtaaattttggcaaaccaaatacagtaacatataaacaggaatgtacaccagtacccagtacagtgtatccctggaatgcaacgttatttcatcagctggaaatgattagtgcaacagactgaaggaagaaaacaacatggtcatctcaatagattgtggacggctggaagtggaggctcacgcctgtaatcctaatactcctaccaacagtgtataagcattcctttttctctgtaacttcaccagaatctgtttttttgtttgtttgtttgtttgtttttgactttgtaatagccatgggctgggctcagtgactcacgcctgtaatcctagcactgggggaggctgaggtgggcggatcacttgaggtcaggagttcgagaccagcctggccaacatggtgaaaccccatctctactaaaaatactaaaattacctgtgcatggtggcaagtgcctgtaatcccagctactcgggagtctgaggcagtagaatcacttgaacccaggaggtggaggttgcagtgagcggagattgtgccactgcacttggacctggctgacacagcaagactatgtttaaaaaaaaagagagagaaaaaaaaaatagaaggtggaaaaagtatttggtaaactaagaagtaaaccacaacctagtaaagggcatattttaagaattcacaactagaacctggtgccgtggctgtaatcccagcacttggggaagccaaagcaggattacttgaggccagaagtctgagatcagcctaggcaatataaggatactctgtatcttaaaaaaaaaaaaaaaatccagatgtgatgacacatgcctgtacgcctagctacttgggaagctgaggttcatgtttacaatgagctatgatgatgccactgtactcctgactgaacaacagagtgagaccctgtctctaaaaagcaaaacaaaacagaaaacccaaaaccctcaaaactaatgttacacttagtatttaaagaatgctttctctgtaagaagaggagcaaggacaggataaaacattcttgccagttctgttcaacagtgtactggaagtatctgtgacattaattgcattgcatatggaaggaaataaaattttttaaataggaagcagcaaaaccttttgcagatgacatggttttgtacatacacaaccccagtggatccaataaatttggattccaataacaagatcatctcagcaagtttttgtgatttaagattacaatccaaaaatcagttgtatttctatatattattaaagaagtcaaaagtgacatcattgaaacatttttatttacaatattattaaggcaaaatactgtgggataaagtgaaattcagcatgaactgtgaataacacaaaatatttgtcagaggagttgaggaatatctacatatgtggaaagacatctcatatttgtggactagaagatttaagcatcgctaggtgcggtggctcacgcctgtaatcccagcactttggtaggctgaggtgggcggatcacaaggtcgggagttcgagaccagcctggccaatatggtgaaaccccgtctctactaaaaatacaaaaaaattaggcgggtgtggtggcgcatgcctgtaatcccaatccctctaggctgaggcaggagaatctcttgatcccgggaggcggaggttgcagtgagccaagatcgggccactgcactccagcctgggcaacagagctaggctccctctcaaaaaaaaaaaaaaaaaagcatcaaaaggatagttcattaatggaaataataaattgaaaaagggaaggacatcaaagtttaatgcttttactttttcataataaccataaatagtatgaaaatacaaactatattcatggaaaatgttttgtttttattttttttgagacagaattttgctcttgtttcccaggctggagtgcaatggcacgatctcagctcaccacaacctctgcctcccgggttcaagtgattctcctgcctcaacctcccaaatagatgggattacaggcatgtgccagtacgcccgcctaatttttttgttatttctagtagagatgaggtttctccatgttggtcaggctggtctcgaattcccgacctcaggtaatctgctcgcctctgcctcccaaagtactgggattataggtgtgagccaccatgcccggccctttgttttcaaatctcatatccaacattggacttatggctagaatatttacataattctcaaaagatagtattaaaaatccaaagctttaaattagaaaatgggcaaaagtcatgaaagaacattcccctgaggatagggaaatgtcaataaggacatgatggaaattaatactatgatgagatattacagaagatttatttttctttgaggcggagtctgcctctgtcaccgaggctggagtgcagtggcatgatctcagctcactgcaacctccacctcccgggttccagcgattctcctgcctcagcctcccaagtagctgggattacaggcgcctgccaccacgcccagctaatttttttttttttttttttttttgtatttttagtagagacggggtttctccatgttggccaagctggtctcaaactcctgacctcaggtgacccacctgcctcagcctcccaaagtgctggaattaagaggtgtgagccaccacacctggcctacagcagatttatttcagtagctgaaatagttaaaacataatgattccaaaggctgagaagcatgcagaaaaaattgaatctttattgctgatgggaatataaaactgtataccacattggaaaataatttggcaatttcttttaaagctaaacacacacatacagttagttaggcttagcaattgctgtcatggcctatttcatagaaatgaaaatttatgtgtagaccaaacctgcacttgactgttcacagaaattttatttgtaatagtcagaacctggaaacaactcacatgttattcaccaggtaaacagttaaataagtctgttatttccgtattgtgtaatacaactcaaaaattaaaaggaataaactactactatacaaataagccttagatgattctcaattctgaaggaaaaacccatttcaagttgtaacataatgcttatttttatgtatcttaatgtgatgaagttaaatagtttagagaacattgttcgtattcatctgttagggatggtagaagttagggttgtatgtgattataagactagtggaagggatacgtttttaatgatggatgagttctgcattctgattcatgcagtggttacaaaaatgtatacatgtgataaaatgtcatgtaaatgtgcacatttcaccaatgacaatgtgctggttgtgatattgtacaatgttaatggaaaatatcaccactggggaaaattgagtggtatgtgtaaacggtactatatttgcagcattttgtgagtctttattttaacataatatgtaaatatgtaaagcaactagaagaatggttttaatacaggagagtaacagcttataagcaagagaaagaaaaatgataaataatgtgaacacttaccaaaggaagggtggaacagagaaataaaggacagggaaaattatctgggatgattcctaaattccaatatttggatggaactatacagaattttaatatatctggaaaataaactgaaaatattaacggatccacagatattgaagacttaaccttttttatctcattattcattaaaacaagtgaaatgttatagggaattcttcaaattgaaagaagcagctcatgcataacacaaaaacatgaatgtataaaactgactggtaaaaggtaagtaactcaaattcacagtactggtatactgtaatggtggtgtacaaataacgtatatctttattgttaaggttaatacacaaaacttttttaatgagatggctgttgctatgttgctcaggctggtctgaaacttctgggctcaagcaattttcccccctcagccttctgattagacggtattatgggcacctgccatgatgtccatctacaaaactattaataattacaacaatttgtttagccatatgtgatataaatatatgtaaggtgtgacatcaagaacataatgggtcaccaaaatctcagagtaaaaacactctggttttactcacccccatagaacctcagtaatatatccagcaccaatattatcacaagttatatcccagaactgaaatccgaggctgagacatttcctcagactacagagaagtgaaaaacttggagcagatgataaaaggcttcttctgtatttatgagactcctatgtgcctgccatcatgtgtggaaaattttatcgacattcaccagttcaacatgggataaatgtgagattttggcacacagcttcttcaccatcttggcttctcttgttgaaaagctgttaatagcttaaaacatgggaagtattgtgtgtgcttgtagaaagaaaatcccatgatggcagtgaaagacaattgggccagttgagattcacaactccagcctgaaaattttctttacgtcagacaacatagatgccaagtcagagtggctgttcagcagcactataatgtagtaggcagagttcatagttctttgcacaaatgcctatccaaccttcctgcacagccagaggattgactttgggacccctatatgggatgggcaatgctccaaatgtttgtgagagctgagtcaaatctaaaacaggcagcactcacggattaagtagtcttgacagggaactacaaataataatatctaagaaaatatactctaggaagaccaaaaaaagctagacagctgagactggaataaatatataattaattgttcaatgtgaaactgtaggcatacgtctacaagaaacagcagcaagccaataaccatgactaccctgaacagagaaagcatggagccagttgccatccctaatgagatggtaatgtttgaactctagaatcaagaattcataaatgcaattttaaggaaatgtagcaaaacccaagataatgcagaaaaggaatccaagaatgtattagaaacttgaagagattgaaataatacaccaaacaaatattgcaaatgagaaataattgtttcaactgaaataattattagaggatgtcattagcagaatggatcaagcataaaaaaacagtgatcttaaagatagggtattggagaatctgtagagattaaagaaatagaaaaggcctagagaatagctacaggatatagagaataacgtccaaacagcaaattaaataatcattggtgttcaagtggtagttttggaatagcaagggcagtaaagcttattcaatgaaataacaatacattccaaatgtagaggaaagtacttttcaggtacaacaacgttaaagaccaaatagattcagtttaattaagaataccccaaggtgtgtgtgtgtgtatatatatatatatatatatatatataatcatctcaaaaacatactacaaagagaaaggacactgaaaacagcaagagaaaagcaaataacattatatacttccaatttgtttgttaacagacttctgatcagaaattgtacataccaggagggagtgaagtgacataaagtgctaaaggaaaaaagttaaccaacaatactgtacccacaaaagatttccttgaaagattgagagataacatcgtttacaaaaagaaaaggaaacatggtgagaattcatcactagactcgtcattcaagaaatgctaagttctttatcctgaagaaaattatgctaacgtccaaagagaaaaagtttgacattacaaaactcagtggccaatgcaaatacataggcaaatgcagaataaattaatacgcttgttttgtgtaagcctcttatatccataatacgaggagtaagatgcaagtctatgaaaagtaactatagcagcatcataaaatatagccaatttaaaaatagacatgagaaagtcaaaatgtgggggaattgaattaaagcataaaattgattggctgtttatattccttatgatgaaaattattatcggtttaaaaatacttttatctatgagatactaccaaagaaagtcacttaaccacaatgggagaaggaagaaagaaataatttggaaaacgacaaaaaagtaccaatcaaaatgtcaatagtgatttcttacctatcaataataatattgataggtattatctaggatccccctaaaaagaacagagagtggctcagtggatattttaaaaaatcggctgggtgtggtggcttacgcctgtaatcccagcactttgggaggcctaggtgggcggatcacctgaggtcaggagactagcctgaccaatatgatgaaaccgcgtctctactaaaaataatacaaaaaaattagccgggcttggtggcatgcgcatgtaatctcagctactcgggaggctgagacaggagaacagcttgaacccgggaggcggaggttgcagtgagccaagatcacgccattgcacttcagcctgggcaacgagcgaaattctgtctcaaaataataacaatagtcagtcccaactatatgctgcatgtaaaaaattaacttacatatacacattgactaaaagtgaagggatgcaaaaagttttcaaatggaaaccaataaatagcagctgtatttgtatcagataacagaaaattttcacttaatatttattaggtgaaaaggtgtgaatagagacaaaaaagtattatgtagtaaatacttatgaagggtcaattcaggaagagggtataaaaatcgtaaatatgtatgcatcctgcagcagaacaccaaaatatataaagcaaactgtaagcgacctaaagcgagagaaactgcaatacagtaatagtaggggactttagtaacccttcctcaactcttgtcacctgagtacacagaggcttattccaactgggggaacgaaatagaagacagtgggataatttgcctagtaacccaggcagttctaccctggtattccccaagtccaccagtgctgtgtatgtgccaggctttaagcctggctgtgttcctggtcctagggcgccctctagtgatgaaatggttgcagtgaccacattcttagataaaacaacacaatcacatttaatttttgggacgccctgtgaagaagggcagctacgaagtagcagactacaaagattggaataaatacctaactcttaaatgcctggacactggagaacttccacaagcataagaccatccaggagacatgacatctccaaaaggactatgggatctagttttggagcgatgtagttatgttgcctctcatacaggaaactcaaaatagctaggaactatgatctaaaatatacaaaggaagtagccactgaccgaccctaatgagatggtgatgtgtgtgatgtcagggtaagaattcaggagaaacgttttgggaaaatagcaaacaccatgataatgcaggaaagcaattcagtaatttattaaatgtaacaaatactgaaacaatagataaccaaactgaaatactggaactgagaaataatgactgaatggacaaatgcaccagaaggtctcaacagcagcactgatccagcagaacaagaatcagtattattaaagacaggctatatgaaaatgcacagtgagtgcagaaagaagcaaaaagaacaaaaaagtatgaagcatgcgtacaaggtgaagaaaataatcttgaaagcacaaacctcagagttaccattcttaaagagggagagtttggagttgaaagtttagagaagtaggccgggcatggtggctcacgcctgtaatcccagcgctttgggaggccgaggtgggtggatcacctgaggtcgggagttcgagacgagcctgcccaacatggtgaaacccacgtctctactaaaaatacaaaagttagctgggcgtggtggctcacgcctgtagtcccagctacttgggaggctgaggcacgaaaattgcttgaaccagggaggcagaggttgcagtgagctatgtatgtgtatatccagatgtgattacccaggtagaagacagtaaaaaacaaaaacaagcagattcaaccaaaataaggctttgccaaggaatgtaacaatcaaatgttcagaggtagagaaaaatttaaatggtcctaaaagctgcaagaaaacaagcaaataatgtataaatgagctctgatacatccggtagtgaagagtttacaggctaggagggagtatgatgacatatttagtgctgaaggaaataacctgccaaatcagaatatcaaattcagcaaaatattcttcaaacttgaaaaataaatactttaccagacacacaacagctgaggaatttttgtcaacatcagacttgtcttaaatgctagaaagagtaattcagtctgaaaggacattaatgagcaaaaagaaaacatccgaatgtttacaactcatagaaaaaggaggtacataaatatagaataatactgtgattgtggtatgtaaacatatttttagcaggaagaagactaaaaggtaattctattaaaattataactacaaaaatattagagatagataaacataacaaagataagatcatagcatgtagggtggagattaagtgtggagttctttggttttctctttgcttgtcattccttgtgactacagataccttgtcattaatttaaaattattggttatatgatggtttttgcaagccgcatgacaacaaccatgcaaaaacctcagaaaataaaagcaaggaattaaaatatactatcagaaaaaaattagttaatggaatacagggaggaaagaagaatggacgagaggaccaactaagcaaaatttgaaagaatggaaaaggagcaaacactttcagtttcattctacaaggccagtgtttccccgataactaaaggaaaaggtctaaaaacccccaaacaacaataaaccccagaagacaaatatgtctgattcacacagatggaacaatccagaagaaaatgctagtaaactgtattcaacaacacactaaaaatataattcatacttatcaaggtggattaatcttaggaatgcatggattgttcaagctatgcaaatcaattagttttatgtcgtataacaaagtcaacaaccataatgttgtaatggatgtccaaaaagtattttataaattaaatattttattaaaaattatctcaaaattgggtatagagttaagatatctcaacagactggcagttgaacttacactgtccttgtgagcaaggaaaactgacaagcatactgctagatttggaagacattaaaaatgcccatgttcagcactttagttcaccatgttactgggagttctagtcagagcaagtataaaagagaaacaaataagggcattcatattagaaagggagaattataaatatcccaacagatacaaataaaatatataggaagaaacttaaccaatcaagtaaaatgtatctacaaggaaaactatgagtcattgatagaaattgaagaggacactagtaaatgaaaagatactgcatgttcatttagcgggagaagttatattgttaaaaacccatactacatatagcaatctatagtttcaaaatgccagtgttattttttcacagaaataggaacaagacgaagaatagacacagtaatcctgagccaaaagaacaaagctggagtcatcacattacctgacttaaaattatatgacaacgtaacactaaccaaaaccgaatgtgacttgcatacatatacatacaccaatgtaacatctacaaaccagaaatccatgtattgaaactaaacttggcctatcagagagctccaacagcccaggctccacaggttgagtgagtgctgccagcacaaatgtatttataggtgtttgtaatcccgctcctgctgggccatcactcgtgcaatcgtgtgcatgaacaacggtaacctcgccccttgtttgttgttactggtgcgaatgggcaccagcaactccacacctaccattctgccccaagtgcaaatgtgcacatgggtggcagcaactagcctcctctagggcctcatatttgcagccagtggcatgagttctagcatggacgatgttaaaccctactcttccagtgtccctccccatctgacacatgtacactcttccatgctgttgaggctactggcacgagcaagtgagcctggatcccactgccaccaacccaatgaaatagtatggctaccaccccctatttgaaaactgtgggcagcgtaacaggaacacatccgcccctccagttcggcatgtttctaaccttgagggaccagagaacacagcgtcctttcttgaccctgcttccccagagttagagcatgcagcccaggaatcctgaggtgagccttggccccctaaaatcttccagaaatgaagccagtcaactgaacccactttacacctcaatcaaaacccaagggcattgaagaagattaaagaaaaacatcatacaaagcacagcatcttcaaagatggaaagaatattagtccacatacatgagaaagaagtattgcaagaactctggcagtttgaaaagccatagtgtcttctaacttccaaagggccacactagctttctgggagaggttcttaaccaggctgagatgggttaaatgacacagggtaaagaatatgggtatgaatgaagatcattgagattcaggagaaagttgaaacctaatctaaggaatttaaggaacacaataaaacaatacagatgttgaaaactgaaatggccattttaaaatctggtagagctgaaaagcacactacataattacataatgtaattgggagtattaacagcatagatgaagctaaggagaatctcagctctaagactatttagttgaattagctgtcagacaaatattttaaaaaatttaaaaactaaacaaaatctctatgaaatatggcattcaaatctatgagtcactgacattcctgaaagaggcaaagaaagcaagcaactttttagtttattgtccatcagtttttctgcaaccttgctagagaggccaaaattcaaattcaggaaattctgagaacactgcaaaatactgtcccccagacagttatcagattgaaatgaaagaaaatgtccaaaacaactatagagaagggccgggtaaactacaaagggaagcccatcaggctaacggcatacctttcagcagaatccctagaagccagaagatatggatacctatattcggcgtttttaatatgaagtgattccaaccagtaatttcatattcagccaaattaagctttataggtgaaggagaaataagatcctttacaggcaaggaagtgccaaggcatttcattaccaccagacctgccttaccagaggtccttaactgagtgctcaatatgaaaaggaatgaccattattggccaccaaaaaaacacatttaagtacacagaccactgacactataaaccaaatgcacaattaaccagcaaccagctaatagtaatacagaatcaaatataaacatatcagtgttacgtttgaaattaaatagactactgtcctaataaatgataaaaagaggcaagttggataaaaaagaccgaactgtatgctgtcttcctgaaacccatttcagaagtaatggcacccattgactcaaggtaaagggatggagaaaattctaccaagcaaacagaaaaaaggaggagggacagattgctattctaacttcatagaaaatagactttaaaacagcaattgtcaataaggacagagaaagatataatcatgaagagttcaactcaacaagagctaactatatatgcactgaacacaggatcatgcgcgttcataaaagaagttcctacagacctatgaagagacttagataagcagacaataagagtgggaaacttcactaccccattgacactattagatcactgaggctgaaagctaagagatattttagtcctgtacttgacacttgaccaaatggacctatcagacatccatattaatgtccacccaaaaccaccaagtacacattcttctcatctgcacatggcacatactctatagttgactacacagtgggccataaaacaatcctcaccaaattcaaataacagcaaaatcatactaaacagatctttggaccagagcacaataaaaatagaaatcaacacgaagattactcaacactatacaattacatggaaattaagcaacttgatccttaattatgttggcataaataatgaagttaaagcagaaatggacaagttcaatatctcaatttaacaagctaatataacaaacagaggaattagaaaacgagtacactaattccaaagctagcagcagacaagaaataactaaccagttttgaaattgaatcagtaataaaaaccctaccaaccctacctggacctgatggatttatggctgaatacaaccagatatgtaagaaagagctggtgaaattcctagttaagctattccaaaatatcaaggaggaaggactcctcccttaatcattttatgaagccagcatgatcctgataccaaaacttggcagagacacaacacaaacttgagacaaatatccttgatgaacttaaaaggaaaaattctcaagaaaataccagcaaacctaatccacttgcatatcagaaagcaaattccccatgattaaggaggctatatttgtgtgatgcaaggttggtacaacatacagaacttacgaaaaaaatgtgatttatcacataagcagagctaaaaccatgttcatctctatagatgcagaaactatttatttaacattacttcatgttatgaaccctcaacaaattaggcattgaagaaacatatctcaaaataatgacccatctgttacaaactcacagccaacctcataatcaactggcaaaagttggaagcattccttttatgaccagagcaagtcaaggatgctcagtgtcaccacacctattcaacatactactggaagttctagctagagcaatcagttaatagaaaaggcatccaaataggaaaagaagtaaaactatctctgcagacaacatgattttatacatagaaaacctcaaagccccaaagctcctagattagatacaaaacttcaacaaagtttcagtataaaaagtcagtctgtaacttagcatttctatacagcaccaacatcaaagctcagaattgaatcaggaaggcaaacccattcacaatagccacaaaaagcataaatcacccaggaacacatttaaccaggaaggtgaaagatcactataaggagaattacaaaacactactgaaggaaatcatagatgacacaaataggaagaaatgacattgttaaaatggccataatccccaaagcaatttatacattaattgctattcaaactaccaatgacattctttgcagaattaatacaacctttaaaaattcatatggagtgaaaaagtcctaatagccaaggcaattctagacaaaaaacaaacttggaagcataacattacctgaatttgaaagtattctacaagattacagtaaccataacagcatggtaccggtataaaagtagacatggaggccaatggagcagaatatagaacacaaagctgtacaccaacagtcatctgcttctcaacaaagttgacaaaacaagcaatgaagacaggacttcctgttcaataaatggtgctggcataactgactacgtatatattcaaggttgacactggaccgcttccttacattacatataatgactcaatatagattaagggcttaaatgtaaaatataataccataaaaatgctaaaatataacttaggaaataccatgctgaacataggttctgaaaaatatttatgatgaagactccaaatgcaattacagcaaaaacaaaaattgacaaatagaacctagttaaactatagagattctgcacagcaagagaatctatcaatggtgaacacaatgtacagaatgggagaaatatctgcaaattatgcatctgacaaagttctaatatccagaatttataagctacttaaattcatggggagaaaaccacattgaaaatatgaaaaagtacatagacattttttcaaaggaagacatgcatacagctaggagtcatatgacaaaatgctgaacatcactaatctatagagaaatgctaattaaaaccacaatgcaattctgtcttacaccaaccagaatggctgttactaaaaagtcaaaaatagtacgttgtcgaatctacagataaaagggaatgcttatggattgctcgttgaattgtaaattatttcatccattgtggatagcagcttggtgattttgccaataacaagaacatcaaacagaaataccatttgatgcaggaatcccattattggttttataccaaaaggagtatagattttaggaccataaagacacatgaatgtgcatgtcaattggagcactcttcataatagtgaagatatgaagtgaagcttaacacccactgatggctgaccatatgaagaaaacatacatgtacaccatggtacactacaacatcataaaaaagaatgaaattatgtcctttgcaccaacatggttgaactattttgaaaatacgtggcagcaatgtcaaatcatcagaagaaaaggaaccatatgattttgtaaatgggcaaatagagtaaccatttctccaaagaatacacaaacatgaccaagaagtaactgaaaaaaaaccacaagtcaaaaccacaatgtgagattctctcactgcagttcaaatagctgttatcaaaaggacaaataatgctgtcaagcaagaaggcaaaagggatctctgataacactgttgggggagtcttgctctgtattccaggctggagtgcagtggcatgatctcggttcactgcaacttttgccttccagattcaagcaattttcctgccccagcctcccaagtagctgggattataggcatatgccaccacacctagctaatttttgtatttttagtagaggcagagtttcaccatgttggccaggctggtctccaactcctgacctcaggtgatccacccgccttggcctcccaaagtgccgggattacaggtgtgagccaccacgcccagccaatattcacggttttctaaaacaattagttgataaaactaccatactattcagcatttcttccatgggctacatccaaaagaagggatgtaaatatattgaagagatagctgcactgatatgtttatggcagtatttacaatcactaggatatagaatcaccctgtgtgtccatcagttgatgaatggataaagaaagtgtggtatgtatacacaatagaatgaatattcagtcatacttaagaatgacatcctgtcacttgcaactacatgtatggaacagtaggacataataagtaaaataagccaggcatggaaagactgtgtattctcactcatttgtggtaggtacaaagaacctatggatttagagggtggaatgacggttatcagtaatgggttgatgtgttaggaaaaggaaataaggagggtatggttaaggagtacaaaatgccatttgaaagtaggaataagatctgttttgcgggagaacaataggacagctatagtaaataattattgtatatttgaaagtaattacaagagtagaagttgattgttcctaacacagagaaatgatgaatgctcgagggaatgtatatctccattaccttgttttgattgttgcacatgacacatttgtattgcaatatcatgtgtcccatatatatgtacatatatacaactatcatgtcccaataatatttaagcatatgtgatttttataaacaagtgaactagttaggggtagataaatctaaaataaaaacaagcataaatctatatataacaagtctacagctaatataatgaacaattgaaattccttcctctaatatctggaacaggataggatgcccactttcaccacttttattccatataacattctatccagagctattaggcaagtgaaagaaataatgggcatccaaatgaagagaagttaaataatattgctgcaggattctaaggagcaatacagaaatttttagcatttacatttgccaacagtgaaaaatctgaaaaagaactcaagaaagcaatctcatttggaatctctacaaaaaaatcaaatagtcaaactttgaagtcatgaaacatccctacaaggtattgagggaaccggcccccaatatttcaatgtaggttcttttctatttttcctaagtgttggccggtctgagaaataaagggtaagagtacaaaagagagaaattttaaagctgggtgtctggggaagacatcacatgtcagcaggttctgtgatgccccgagccacaaaaccagcaagtttttattagcgattttcaaaggggagagagtgtacgaatagggtgtggatcacagagatcacatgcttcaaaggcaataaaatatcacaaggcaaatgggcagggcaaggtcacaaggccagggtgaaactagaattgctgatgaagtttcatgtcccactgtgcatgcattgtcattgataaacatcttaacaggaaacagagttcaagagcagagaaccagtctgactagaatttgccaggctggaatttcctaatcctagcaagcctgggggtgctgcaggagaccagggcatgtttcatccccatctacaactgcataaggcagacactcccagagcggccattttagaggcctccccctgggaatgcattcttttcccagggctgttaattattaatattccttactggggaaagaattcagcgatatttctcttacccattttcggcaataagagaaatatgactctgtcctgcctggctcccaggcagtcaaacctaatggttatctcccttgttccccgaacatcgctgttatcctgtcctttttttcaaggtgcccagatttcatgttgttcaaacacacatgctttacaaacaacgtgtgcagttaacacaatcatcacagggtcctgaggcgacatacatcctcagcttacgaagacaacaggattaagagattaaagacaggcataggagattataagagtattgattggggaagtgataaatgtccatgaaatcttcacaatttatatttagagattgcagtaaagacaggcgtaagaaattataaaagtattaatttgggaacaaacaaatgtccatgaaatctttacaatttatgttcttctgccatggcttcagcaggtccctccatttggggtccctgacttcccgcaacaaaaaggaaaacattgataatggaaactgaataggacacaatgaaatgggaaattattcataattaaaatatcattactgcctaaagcagtctgcagattcattctttttgtatcaaaaatcaatgatattcctcatagaaatagaaaaagaattcataaaattcatgagaccacaggagatactgagtatcaaaagtaatcctgaggaaaagcaaagatgaagacatcatactacttcaaaagatactacaatgtcattgtaaacacaatgtgatgatattggcatgatatacacgtagatcagtgggatgaaatcaagaacccagtgataaatacagacatttacaaaaaattcatttttaaaaatcaccataaatatatgttgtggaaaggatagtgctttcaatgaaagttgctgggaaaacttggtaatcatatgcagaagaatgaatcttaccatatgtaaaaataaaattaatatgggttaagtgcttatgtctgaaactataaaaagtggtagataaaatctttgtataaatgcttctggatatttgtctaggcaaagatattttggtaagctctgaaaagcagaggcaacaaaagcaaaaatagacataagttcatacatctagctaaaatgcttttgcacaatagaggtaacaaaatagtgaaaccaaaattataatgggaaaaaacctgataactatgttttttacagcgatgagaatatatattcatatcatcagaaggcaagcaaataatctgattttaaaggatagattaaaagaaggcataagttgccaacaggtatatgtaaaatttttcatcatcactaatcatcatggaagtgcaatttcaagccacaatggaatgttgtgcaattaaaacaaatatctaaaagacaacagatggtgttgagcatgcatacaattggttatgctcatgtactgtttctgagaatgtaaatttgtatagccattcttgaaaacagtattgtgttgtctcataaaacaaatgatgtaaccactatactgtgtcaattccactactcagtatttatcacaatgaaaggtatcagtatattaggaggatattttcatccatctccttattgcagctctattcacaatagcttttgaattaacctgaaagttcatcaagggatgcatggaaaatggcaatattatatatatgcactattgaaaattgttaattaaaaggaacaaaatcatatcactttcagtaatatgactggaattggaggtcattatggtaagtgaaagaagccaagcacaaaaaaataaacactgcgtgttctcatgtatatgttaaaatataaaatagttgatctgcttggtgcgcagagttgattgctggttactgaatgatcttctattcaaggggggaagacaacaattttgactaatgagtacaaaaacaagtagaataaataagtcctaatatttgatagtacagtaaggtgacaacagtaaacagtatttcatgttattgtttaaggttgctgaaataatagaggaattataatgttcctaacataaaaagagactaatgtttggggtgatgcatgtttcaactaccctagttcaattactactgactgtattcatgtatcaaaataccacatgtaccctctaaaatgtacaacttttatgtatccaggtgaatattcaaaattcagagattagtgtgaaaatgttaccgcttatttttccatcaaaattgttattaaaatagcttatcaggtgtttttgttgtctcatggaaccaccaaatatctatagtagatacacaaaaaataaaaagtaagacattttacaacaccacaagattaaaaaataattacaagatagtgggagaataaaaaaatgaaggaaggatctagtaataaacaagaaagcaatttacaaacatttctttaaatattaacaatattttgaatctaaatggaataaattcttcattaaaaatagagtagcagaatggatattataaaatactgcctataagacactcacttcacttgtaaggacacatggactgaaagtaatgggatgaaaaactattgtatagaaatcgaaagcaaacgagtatcagtagctaaacttattccatcaaactatacatgaagccagaaaccataaaatttgggaaataagtttattacataatggtaaaaggggttaattcagcaagaggttatagtaattgtaaatacatatatacccaaaacagaagtgctcaatcatataaaacaaatataataacttctgagtggacagatagattgccatacaataataataggggacttaagtactgaagtttcagcaatgggcagatcatctggatctgacttacactacatctggcttacactacactttatgccaaataaagcaaactgacgtatacagaatacttcgtctaacagcggcacaatctacattcttctctgcagaagatggatctttgcgtaggccttatgttacgaatcaagactagttttacatttaataatacagaaattataccacatttttaagcacattgcatgaacctaggaactattagtagaatgaacattagaatgttcacaaacacatagaaattaaacaatatgcttttgaataatgaatgggtgaatcattaaatccaaatggaagttaaaaaatattttgacaaatgaaagatgaaacacaaaacaccaatatttgtgataccagaaaagtacttaaaaaataaccttatgttacacctgaagcaactattaatataatgggaagaacaaacagtccaaattttacagaaggaagcatataataaagagcagcgtagaataaatgaaaaaatttgtactcatacaacgtacgcaaatccagtcatgagaaagaatatctgaagagaccaataacaagtaaattgtatccataataaaaatctcctatcaaatatatgcccatagtgcttcactggtaatttctgtcaaacctaattccactttatattaagaggattacttgccatgttcaaatgggatttgtccctctgaggcaaggatgttttaaatagtcttataaaggaggagggacaccgccatttgatcatctcaatagatttaaaaataaaacagttttatagaatttgatataataaaagctgtcaaccaattaggcatagaaggaatgtatctttataccatataggcagtaaatgaaatacccacaactaacatcataatcaatgaagaaaacatgaaatattttcttcggaggtaaagaagccaattatgcccactctcagcacctcattcaacctagttcgggatgttctagccagtacagttaggcaagagaaggaaattaaaggcattcagatcggaaaagagggaggcaaactgggtctgtgtggagatgacctgaacttatgtgtagaaaatacactctcctggccgggcgcggtggttcacgcctgtaatcccagcactttgggaggccaaggcgggtggatcatgaggtcaggagatcgagaccatcctggctaacacggtgaaaccccgtctctactaaaagaaaaacaaaaaaataaattagctgggggtggtggcgggcgcttgtagtcccagctactcaggaggctgaggcaggagaatgacatgaacctgggaggcggagcttgcagtgagccaagatcgtgccactgcactccagcctgggtgacagagcaagactctgtctcaaaaaaaaaaaaaaaaagaaagaaagaaagaaaatacactctccccttaaaaccttttggaagtgataaagaaattcagtaaaattgcataatacaaaacagccatacaaaaacctgtagcatttctatatcccaccagtgggtaatttcaaaaagaaaacaagaaatgagtctcattgacaatagcttacaaaagtaccgaggaagagatctgaacaagccaaagatttctgtaatgaaaactctttaaaaaataattcattttgtaataaaagcattgaaggaagaaattgacgacacaaatgagtagaaatatattttatatttatgtgttagaataatttatatcttaaaatatatatactactcaaagcaatctattgatctgtgcatccctattaaatttctgatgttatgttagttttgtctataaacagaagaaaataattctgaaattgtatggagcaacaaaaatcttaaatgaaaaaatattaaagaaaatgaggagatccagggtaattgaagtatctggctttaatatagactacaaaattatagtaaccagaacagcattgtctggcataagacagacacagacacaactggaacagagtagaaaggaaataaactaaagctcctaaacataactgattcttcacaaagttgccaggagcacacttcagggaaaataaaacatttaccgtgtaaatggtactgggaaaatttgataattacatgcaaaagaattagattagaagtctacatctaaaaatacacaaaaattaactcccaattgaataaagaattaaatgtaaaattggaaactatgaaacttcttgaagaaaatgggggaaatgattcatgatattttgctgggcaaggatttagaaatgagacctgaacttttcagggaataaaaggaaaaataaccaaatgagagtatatcaaagtttaaagcttttgcacagcgaaagagtattaaaagagtgaggagtcatcgcttctcggcctttgtggaagtcagtgtggcaattcctcagggatctagaactagaaataccatttgacccagccatcccattactgggtatatacccaaaggactataaatcatgctgctataaagatacatgcacatgtatgtttattgtggcactattcacaatagcaaagacttggaaccaacccaaatgtccaacaatgatagactggattaagaaaatgtggcatatatacaccatggaatactatgcagccataaaaaaggatgagttcatgtcctttgtagggacatggatgaaattggaaatcatcattctcagtaaactatcgcaaggacaaaaaaccaaacactgcatgttctcactcataggtgggaattgaacaatgagaacacatggacacaggaaggggaacatcacactctggggactgttgtggggtggggggaggggggagggatagcattgggaggtatacctaatgctaaatgacgagttaatgggcgcagcacaccagcatggcacatgtatacatatgtaactaacctgcacattgtgcacatgtaccctaaaacttaaagtataataataataaaaaataaaagagtgaggagtcaatttacagtattggagaaaatatttgcaaacagtatatgtgacaaagagttaagaagatataaccaacgtaattcaatagcaagaaaaaagtaatatgaattttaaaaaattggcaaaaattgctggctgcttcactcctggaaccttcactaaccagatccaggcagccttccgggagccatggcttgtggttactgaccccagggctgaccaccagcctctcacggaggcatcttatgttaaccaacttaccattgctctgtgtaacacagattctcctctgtgatacgtggacattgccatcccatgcaacaacaagggagctcactcagtgggtttgatgtggtggatgctggctcgggaagttctgcgcatgcgtggcaccatttcccgtgaacacccgtgggagttcatgcctgatctctacttctacagagatcctgaagagattgcaaaagaagagcaggctgctgctgaaaagtgaccaaggaggaatcctgtaatttgcaataacatgaataaattttgaagacagcattttaactgtaataagctagatactgaatgactaatgctgtattatcttactcaaatggatactaagaaaataaaaatttgatatcctaaggtcagagagtagaactgtggttacaatagacaggggaggggcctttgatttggccattaggtacaaagtgacaattagagaagactagtaaattattctgttctttcacacactatcatgactatggttaaatgtaaaatactgtatatttcaaaagagttagaatagacacttttcaatgttttcaccactaagaaatgataactgcatgtgattggattaatatgcaacctaaatacatacgaaaacatcacactaaattcaataaatatatgcaattataattttgagataatgaaaaagaaaaattaaaaaattatgacaagcagaggccaatatctatgatgaacatagacacacaaatgctctacaacaaactagcaacctgaattcaacactgcattaaacattttatttttcataatcaagcggtattcatcccagtgatgcaaaaatgattgtatatatggaaattaatgttatgcattacactaagagaacaaaggattaaaaccatatgatcatctcagtcaatatcataaaagcatttgagaatatttataattttttcatggtaacaactcaaacatttaggcaaagaattgggtctccctattccctgagacagaaccacactgaaaataggacaaacagtaaccctgaaatggcctctaacaatgattgaacttagtgaggaaggaatgttgaaggctgagtggctgaaatctaggccactagtgcaataaatcccatgattttaaaacctagagctaacatgttattcagaggggaaaacataaaagcttttcctcaaataaaaaacacatcacaaatgcccaatctcatcacttgcattcaacatagtactggaagttttcaccacagcaataaggcaagaaaataaaaagcatttaacttggaaagagttattatttatttatttatttattttttaaacatgacatgatcatatgtacagaaaactcttaagaatttcaccaaaaacaagtctacaaaaggaattaaatatcactggaggagacaaatgcaacaaaaacaaattagtaatatttctataatgaaacagcaagctatctgacacaaatcaagaaaacaatcccatttacaatatctaacaaaaaataaaatatttagaattaaattacccaaggaattttaatgcctacacaccaaatattaaaaatttttacttttattgcatgtggctttattatgtttctcagatatcatggtgggttttttttttaaacccacccatgtggcaaccctccatccagcaagtcagttggtgccattttttccagcagcattgtgttgactttgtgtctctataccacattttgttaattttccacttttctttatcattgttaggtatagtaagtgaactttcttcagaattcttattaccatttttattatgatattgaactatgaatctcacttaggtaaaatcatgaacttaatcagcaaatgtgttctgactgcttttctgatgagttgttacctcatcttctttctccacctagggcctccctattgcctgagacagaaacatactgaatataggagacacagtaatcctgaaatggcctctagttgtttaagtggtaggaagacttgcactttcttcaccttatatcaaaatctcaaaatgattaaacttagtgaggaaggcacatggcaggctgagtggctgaagtctaggcctcttgcaccaaatagcaaagttgtggaagcaaaggaaaagttcttgaaaaaaattaaaagtgttacttcactaaacacatatatattgagaaagccaaacagccttattgctgatatggagaacattttagtgattcatatagaatatcaaacaagttataacataccatcaagccaacgcctaatccagagcaaggccctatgtcttttcaattatctggaaatggagtgccggtggattttttttctttattgttatactttaagttctagggtacatgtgcacaacatgcaggtttgttacatatgtatacatgtgccatgttggtgtgctgcacccattaactcgtcatttacattaggtatatctcctaatgctatctctccccctccccccaccccacaacaggccccagtgtgtgatgttccccttcctgtgtccatgtgttctcattgttcaattcccacctatgagtgagaacatgcagtgtttgtttttttgtccttgtgatagtttgctgagagtaatggtttccagcttcatccatgtccctacaaaggacatgaactcatccttttttatggctgcatagtattccatggtgtatatgtgccacattttcttaatccagtctatcactgatggacatttggattggttccaagtctttgctattgtgaatagtgccacaataaacatacgtgtgcatgtgtctttatagcagcatgatttataatcctttgggtacatacccagtaatgggattgctgggtcaaatggtatttctagttctagatccctgaggaattgccacactgtcttccacaatggttgaactagtttacagtcccaccaacagtgtaaaagtgttcctatttctccacatcctctccagcacctgttgtttcctgactttttaatgattgccattctaactggtgtgagatggtatcccattgtggttttgatttgcatttctctgatggccagtgatgatgagcattttttcatatgtctgttggctgcataaaagtcttctttagagaagtgtctgttcatatcctttgccactttttgatggggttgtttttttcttgtaaattggtttgagttctttgtagattctgggtattagccctttgtcagatgagtagattgcaaaaattttctcccattctgtaggttgcctgttcactctgatggtagtttcctttgctgtgcaggagctctttagtttaattagatcccatctgtcaattttggcttttgttgccattgcttttggtgttttagacatgaagtcattgcccatgcctatgtcctgcatggtatttcctaggatttcttctagggtttttatggctttaggtctaacatttaagtctttaatccatcttgaattaatttttgtataaggtgtaaggaaggcatccagtttcagctttctacatatggctagccagttttcccagcaccatttattaaatagggaatcctttccccattgctcgttttttgtcaggtttgtcaaagatcagatggttgtagatgtgtggtattatttctgagggctccaatctgttccattggtctatatctctgttttggtaccagtaccatgctgttttggttactgtggccttgtagtatagtttgaagtcaggtagcgtgatgcctccagctttgttcttttggcttaggattgacttggcaatgtgggcccttttttggttccatatgaacgttaaagtagttttttccaattctgtgaagaaagtcattggtagcttgatggggatggcattgaatctataaattaccttgggcagtatggccattttcaggatattgattcttcccatccatttgcatgaaatgttcttccatttgtttgtatcctcttttcttttgctgagcagtggtttgtagttcttcttgaagaggtccttcacatcccttgtaagttggattcctaggtattttattctctttgaagcaattgtgaatgggagttcactcatgatttggctctgtctctgttattggtgtataagaatgcttgtgatttttgcacattgattttgtatcctgagactttgctgaagatgcttatcagcttgaggagattttgggctgagacaatggggttttctagatatacaatcatgtcatctgcaaacagggacaatttgacttcctcttttcctaatagaataccctttatttctttctcctgcctgattgccctggccagaacttccaacactatgttgaataggagtggtgagagagggcatccctgtcttgtgccagttttcaaagggaatgcttccagtttttgcccattcagtatgatatttcctgtgggtttgtcataaatagctcttattattttgagatacatcccatcaatacctaatttattgagagtttttagcatgaagcgttgttgaattttgtcaaaggccttttctgcatctattgagataatcatatggtttttgtcgttggttctgtttatatgctggattacgtttactgatttgcgtatgttgaaccagccttgcatcccagggatgaagcccacttgattatggtggataagctttttgatgtgctgctggattccgtttgccaatattttattgaggatttttgcatcgatgttcatcagggatattggtctaaaattctctttttttgttgtgtctctgccaggctttggcatcaggatgatgccggcctcataaaatgagttaaggaggattccctctttttctattgattggaataatttcagagggaatggtacaagctccgccttgtacctctggtagaattcggctgtgaatccatctggtcctggactttttttggttggtcagctattaattattgcctcaatttcagagcctgttattggtgtattcagagattcaacttcttcctggtttagtcttgggagggtatatgtgttgaggaatttatccatttcttctagattttctagtttatttgtgtagaggtgtttatagtattctctgatggcagtttgtatttctgtgggatcggtggtgatatcccctttatcattttttattgcatctatttgattcttctctcttttcttttcttctttattacttttgctagtggtctatccattttgttgatcttttcaaaaaaccacgtcctggattcattgattttttgaagggttttttgtgtctctatctccttcagttctgctctgatcttagttatttcttgccttctgctagcttttgaatgtgtttgctcttgcttctctagttcttttatttgtgatgttagggtgtcaattttagatctttcctgccttctctcgtgggcatttagtgctataaatttccctctacacactgctttcaatgtgtcccagagattctggtatgttgtgtctttgttctccttggtttcaaagaacatctttatttctgccttcattttgttgtgtacccagtagtcattcaggagcaggttgttcagtttccatgtagttgaacagatttgagtaagtttcttaatcctgagttctaatttgattgcactgtggtctgagagacagtttgttataatttctgttgttttacatttgctgaggagtgctttacttccaattatgtggtcgatttaggaaggtgtgatgtggtgctgagaagaatgtatattctgttgatttggggtggagagttctgtagatgtctattaggtccgcttggtgcagagctgagttcaattcctggatatcctttttaactttctgtctcgttgatctgtctaatgttgacagtggggtgttaaagtctcccattattattgtgtgggagtctaagtctctttgtaggtctctaaggacttgcttcatgaatctgggtgctccggtattgggtgcatatatatttaggatagttagctcttcttgttgaattgatccctttaccattatgtaatggccttctttgtctcttttgatctttgttgatttaaagtctgttttatcagagactaggattgcaacccctgcctttttttgttttccatttgcttggtagattttcctccatccctttattttgagcctatgtgtgtctctgcacttgagatgggttttctgaatacagcacactgatgggtcttgactgtttatccaatttgccagtctgtgccttttaattgggagcatttagcccattttcatttaaggttaatattattatgtgtgaattggatactgtcattatgatgttaactggttattttgctcgttagttgatgcagtttcttcctagcctcgatggtctttacaattcggcttgtttttgcagtggctggtaccggttgttcctttccatgtttagtgcttccttcaggagctcttttagggcaggcctggtggtgacaaaatctctaagcatttgcttgtctgtaaaggattttatttctccttcacttatgaagcttagtttggctggatatgaaattctgggttgaaaattcttttctttaagaatgttgaatattgacctccactctcttttggcttgtagagtttctgccgagagatccactgttagtctgatgggcttccctttgtgggtaacccgacctttctctctggctgccctaagactttttccttcatttcaactttggtgagtctgacaattatgtgtcttggagttgctcttcttgaggagtatctttgtggcattctctgtatttcctgaatttgaatgttggcctgccttcctaggttggggaagttctcctggataatatcctgcagagtgttttccaacttggttccattctccccgtcactttcaggtacaccaatcagacgtagatttggtcttttcacatagtcctatatttcttggaggctttcttcatttctttttattcttttttctctaaatttctcatttcatttcattcatttgatcttcaatccctgataccctttcttccagttgatgaaatcggttactgaagcttgtgcattcgtcacgtagttctcgtgccatggttttcagctccatcaggtcctttaaggacttctctacactggttattctagttagccattcatctaatcttttttcaaggtttttaactttttcgtgatgggttcgaacttcctcctgtatctcagagaagtttgattttctgaagccttcttctctctattcgtcaaggtcattctccctccagctttgttccactgctggtgaggaggtgcattcctttcgaggaggagaggtgctctgatttttagaattttcagtttttctgctctgttatttccccatctttgtggttttatctacctttggtctttgatgatggtgacgtacagatggggttttggtgtgcatgtcctttctgtttgttagttttccttctaacagtcaggacactcagctgcaggtctgttggagtttgccggaggtccactccagaccctgtttgcctggatatcagcagcagaggctgcagaacagcgaatattgctgaacagcaaatgttgctgcctgatcattcctctggaagtttcatctcagaggggtacctggccgtgtgaggtgtcagtctgcccctactgggggggtgcctcccagttaggctactccgggctcagggacctacttgaggagtcagtctgtccattttcagatttcaaactctgtgctgggagaaccaccactctcttcatagctgtcagacagggacattttaagtcttcagacgtttctgctgccttttgttcggctatgccctgcccccagaggtggagtctacagaggcaggcaggcctccttgagctgcggtgggctccacccagttcgagcttcccagccactttgtttacctactcaagcctcagcaatggtgggtgcccctcccccagcctcactgccgccttgcagttcgatctcagactgctgtgctaggaatgagtgaggctctgtgggcatgggaccctctgagccaggtgtaggatataatctcctggtgttccgtttcctaagaccattggaaaagcacagtattagggtgggagtgacccgattttccaggtgctgtctgtcacagctttgcttggctaggaaagggaattccctgaccccttgcacttcgtgggtgaggcaatgcctcgccctgcttcggctcatgctcggggcactgcacccactttcctgcacccagtgtccgacaagccacagtgagatgaacctggtaccttagttggaaatgcagaaatcacccatcttctgcatcgctcatgctgggagctgtagactggagctgttcctattcggccatcttctttttttgtttgtttgtttttttgtttttttttttttttattttgaattggttcatggttccacaggctatacaggaagcatccctgggcatgcctcaggaaattttcagtcatggtagaaagggaagcaagcacatcttacatggctggagcaggaggaagagagtgaagtgggaggtgctacacacttttaaacaatcagatctcgtgagaactcactatcatgagaacagctagtgggaaatgtgcttccatgatccaattacctcccagcaggcccctcccgcaacattggggattacaatttgacatgatatttgggtggaaacacaaatccaaaccacatcgccaactcaaattaacttctgtctatggtataaggtaggagacaacattgttattttccatactgatgtctagttgttcaacaccatttgttaaaaagactttcttttcccattggattgctttggcacctttgtctgtatgttaattaaccatacaaggatggatctattttggtttctgttcttcttttttttaatactgtaagttctggggtgcatgtgcagaatgtgcaggtttgttacataggtatacatgtgccatggtggtttgctgcacctatcaacttgtcatctacattaggtatttctcttaatgctatcccacctctagtgccccacctccccaacaggccccagtgtgtgatgttccactccctgtgtccatgtgttctcattgttcaactcccatttatgagtgagaacatgcagtgtttggttttctgttcttgttagtttgctaagaatgatggtttctagcctcatccatgtccctgcaaaggacatgaattcatccttttttatggctgcatagtattccatggtagatatgtgcaacaatttttttatccaatctatcattgatgggcatttgggttggctccaagtctttgctattgtgaatagtgccacaatgaacatatgtgtgcatgtgtctttatagtagaatgacttacaatcctttgggtatatactcagtaatgggattgcttggtcaaatggtatttctaattctagatccttgaggaatcaccacactatcttccataatggttgaactaatttacactcccaccaacagtgtaaaagtgttcctatttctccacagcctctccagcatctgttgtttcccgactttttaatgatcgccattctaactggcgtgagaaggtatctcattgtggttttgatttgcatttccctaatgacaagtgatgatgagctttttttcatgtttgttggctgtgtaaatgtcttcttttgagaagtgcctgttcatatcctttgcccactttttgatgggcttgttcctttttttcttgtaaatttgtttaagttctttgtggatcctggatattagccctttgtcagatggatagattgcaaaaattttctcccattctgtgggttgcctgttcactctgatgatagtttcttttgctgtgcagaagctctttagtttaattagatcctatttgtcaattttggcttttgttgctttagtcctgaagtctttgcccatgcctatgtcctgaatggtattgcctaggttttcttctagggattttagggttttaggtcttccgtttcagtctttaatccatattgagttaatttttgtataaggtgtaaggaaagggtccagtttcagttttctgcatatggctagccagctttcccaacaccatttatgaaatatggaatcctttccccattgcttgtttttgtcaagtttgtcaaagatcagatggttgtagatgtgtggttatttctgaggcctcttttctgttccattggtctatatctctgttttggtaccagtaccatgctgttttggttactgtagacttgcagtatagtttaaagtcaggaagtgtgatgtctccagctttattctttttttttaggattgtcttggctatatgggctcttttctgctgccatatgaaatttaaagtaattttttctaattctgtgaagaaagtacatggtagcttgatggggataacattgaatctataaattactttggtcagtatggccattttcacaatattgattcttcttatccaggagcatggaatgtttttccatttatttgtgtcctctcttatttccttgagcagtggtttgtagttctctttgaagatgtccttcacctccctggtaagttgtattcctaggtatgttattctttttgtagcaactgtgaatgggagttcactcatgatttggctctctgcttgtctgttattggtttgtaggaatgattgtgatttttgcacattgattatgtatcctgagacttcgctgaagttgcttatcagcttaaggagattttgggctgatacaatggggttttctaaatatacagtcatgtcatctgcagagagaatgtgacgtcctttcttcctatttgaatatcatttatttctttctcttgccttatttccctggccagaacttccagtactatgttgaattggagttgtgagagagggcatccttttcttgtgctggttttcaaagggtatgcttccagtttttgctcattcagtaagatattggctgttggtttgtcataaatagctcttattattttgagatagggtccaccaatacctaatttattgagagtttttagcatgaagcggtgttgaattttgttgaaggccttttctgcatctattgaggtaatcatgtggtctttgtcattgcttctgtttatgtgatgcattatgcttattgatttgcctatgttgaaccagacttgcatcccagggataaagctgacttgatcatggtagataagctttttgatgtgctgctgtattcggtttgccagtattttattgaggattttcgcattgatgttcatcagggatattggcctgaaattttctttttttgttgtgtctctgccaggttttggtatcaggaagatgctggcctcataaaatgagttagggaggagtctctctttttctattgtttggaatagtttcagaaggaatggcaccagcttctctttgtacctctggtagaattcggctgtgaatccgtctgttcctggactttttatggttggtaggctattactgcctgaatttcaaaacttgttattggtctattcagggattcgacttcttcctggtttagacttgggagggtgcatgtgtccaggaatttatccatttctactggattttctagtttatttgcatagaggtgtttatagtattatctgatagtaacttgtattcctgtgggatcagcggtgatatcattttatcactttttattgcatctatttgattcttctctcttatcttgtttattagtttggctagcagtctatttattttgttgatcttttcaaaacaacagctcctggattcactgatttttttgaagttttttcctgtctctatctccttcagttctgctctgattttagttatttcttgtcttctggtagctgttgaatttgtttgctcttgcttctctagttttttaaattgtaattttagggtgtcaattttagatctttcctgctttctcttgttggcatttagtgctataaatttccctcttaacactgctttagctgtgtcccagagattctggtacgttgtgtctttgttctcattggtttctaagaatatctttatttttctgccttaatttcattactcacccagtagtcattcaggagcagtttgttcagtttccatgtagttttgtggttttgagtgagtttcttaatcctgagttctaatttgattgcactgtggtctgagagactgttatgatttgcattcttttgtatttgctgaggagtgttttacttccagttatgtggtcaattttagaataagtgccatgtggtgctgagaaaaatgtatattctgttgatttttggttgagggttctgtagatgtctatcagttctgcttggtccagagctgagttcaagtcctgaatattcttgttaattttctgtctcgttgatctgtctaatattgacagtggggtgtgaaagtctctcactattgtgtgggaatctaagtctctttgtaggtctctaggaatttgctttatgaatctgggtgctcctgtattgagtgcatatatatttaggagttacctcttcctgctgcattgatccctttaccattatgtaatgcccttttttgtcttttttgatctttgttggcttaaagtcttttttatcagggactgggattgcaacccctgccttttttttttttttttgctttccatttgcttggtaaatattcctccatccctttattttgagcctatgtgcatctttgcatgagatgggtctcctgaatacagcacaccgatgggtcttgactgtttatccaatttgccagtctgtgtcttttaattggggtatttagcctgtttatatttaaggttattattgtgtgtgaatttgatcctctcattatgatgctagctggttattttgcacattagttgacgcagtttcttcatagtgtcgatggcctttagaatttggtatgtttttgcagtggctggtacccgttgttcctttttatgtgtagtgcttttttcaggagttcttgtaaggcagtcctggtggtgacaaaatctcagaatttgcttctctaaatgattttatttcttcacttatgaagcttagtttggctggatatgaaattctgagttgaaaattctttttttacagaatgttgaatattggcccccactctcttctagcttgtagagtttctgcagagagatttgctgttagtctgatgggcttccctttgtgggtaagtcaaactttctctctggctgcccttaacattttttccttcatttcaaccttgctgaatctgacaattatgtgtcttggagttgcccttctcaaagagtatctttgcggtgtcctgtgtatttccccaatttgaatgttggtctgtcttgctaggttgggggaattctcctggataatatcctgaagagtgttttccaaattggttccattctccacgtcacttttagggaccccaatcaatcatagatttgggcttttcacatagtcccatatttcttggaggctttgttcgtgccttttcattctttttttctctaatcttgtcttctcactttatttcattaagttgaccttcaatctctgatatcctttctactgcttgaaacagaatctgtctgcagaaactctacaatcaattcatctattgacacctgtgtatgcttcatgaagttttcgtgctgtgtttttttagctccatcaggtcatttatgttcttctctaaactggttattctagttagcaattcctctaaccttttctcaaagttcttagtttaattgcattgtgttagaacatgctcctttagcttagaggagtttattacccacgttctgaagcctacttctgtcagtttgttaaactcattctccatccagttttgttcccttgctggcgaggagttgtgatcctttggaggagaagaggtgttctggtttttggaattttcagccttttgcactggtttttcctcatcatcatggatttatctacctttggtctttgatgttggtgaccttcggatggggtttttgtatggaagtcctttttgttgatgttgatgctattcctttctgtttgttagttttccttctaacagtcatgccactcagctgcaggtctgctgcagtttgctggaggtccactccagaccctatttgcctgggtatcaccagtggaagctgcagaaccacaaagattgctgcctgtttcttcctttggaagcttcatcccagaggggcacctgccagatgccagctggagctctcttgtatgaggtgtctgttaacccctgctgggaggtgtctcctagtcaggaggcacaggggtcagggacccacttgaggaggccatctttcccttagcagagctcgagcactgtgctgggagattttctgctattttcagagctggtaggtgggaacgtttaagtctgctgaagctgcacccacagatgcccctttcccctggtgctctgtcccagggagttgggagttttttctataaacccctgactggggctgctgcctttctttcagagatgccctgctcagagaggaggaatctagagaggcagtctggctacagtttttgccgagctgtggtgggctctgcccagttcgaacttcctggcagctttgtttacactgacagcggaaaactgcctaaccaagcctcagtatcagcagacgcctctacccccacgaagctggggtgggatccactgagctacaccacttggctccctggcttcagccccctttctagggggagtcaacagttctgtctcgctggtgttccaggcgccactggggtatgaaaagaaactgcagctatctcggtgtctgcccaaacagccaccaaattttgtgcttgaagcccagggccctggtagcataggcacctgagggaatctcctgatctgtgggttgcaaagagcgtgggaaaagcatagtatctgggctggactgcaccatttttcatggcacagtccctcacagcttcccttggctagggaagggagttccttgaccccttgcgtttcctgggtgaggcaacactccaccctgctcagctggcccttcgtgagctgcacccactgtctaaccaattccgatgagatgagctgggtacctcagttggaaatgcagaaatcaccttccttctgtgatgagctcgctgggatcttcagaccacagctgttattattcagccatcttgcctgccacccccttaagctttttattattttcccatttctcaggttgtccactgaattttttatcttgtttcttgcagcaataaagagccacaatgttgaatttacctaattgtttgccaccaactaattgtttttgacaattagttaggtgagaagcatttttgtagcgatccaaattaagtcaggtgactctggggacagcaaaactgccagtttaccatgctgtgatactgagtgttgggggatggggtggtgaatgggaacagttgtaaattaaaatgccaagggccaggccgggcgcggtggctcatgcctgtaatcccagcactttgggaggctgaggtgggcggatcacaaggtcaggagatcgcgaccaccctccccaacatggtgaaaccctgtctctactaaaaatacaaaaattagctgggcgtggtggcacctgcctgtaatcccagctacttgggaggctgaggcaggagaatcgcttgaaccagggagccgggggctgcagtgagctgagatcacgccactgtaccacagcctggccacagagcaagactctgtcttgggccaggtgcagtggctcacgcctgtaatcccagcactttgggaggccaaggcgggaggatcacgaggtcaggagatcaagaccatactgactaacatggtgaaaacctgtctctactaaaaatacaaaacttagccaggcgtggtggcgggcacctgtaatcctagctactcaggaggctgaggcaggagaatcacttgaacctgggaggcagaggttgcagtgagccgagattgcgccactgcactccagcctgggcgacagagctagaccccatctcaaaaaaaaaaaaaaaatacaaaagttagccaagtgtggtagcacacacctgtagtcccagctacttggggggctgagatgagaggatcacctgagcctagatgtcaaggcgacggcgagccatgattgcgccactgcactccaacctgggtgacagagtaagactctgtctcaaaccaaaaataaaaagaaaatttgagaaaaataattcttgaggcctatttaatcacttcctagaaaaaattattgacatcactcccagagtcccaggagagcaacactaaatgcaacttagttaaaaatttttctgtcatagccatatacactatattctaaatacacacacataagcacattagatacatattcacacacaataggtagaaacacatacagaggaaaaaaaatatatatatatatatatcctatgtctttcctagacagccctttctgactaaaaaagtatacttttgtgccaatcagagaaaatttcagtcacctaaaaacctcataaatggagaaaatctgttcatagtaaaacagcagtctgaagctctgtggggtaattatggcctccagggctctaccaagtaaagaaagctgtggctgtagctttcatacttgggaggctgaggcaggagaatggcatgaacctgggaggtggagcttgcagtgagtcgagatggtgccactgcactccagcctggatgacagagcgagactctgtctcaaaaaaaaagaaaagaaaagaaaatactctgtctcaaaaataaataaataaataaataaaataagcaagacttacagtgaaaaaaccatacagattggaaaggaaggaaaaatactgtctctattcacagatgacatgactatttatgtaaaatattcccaaagaatatacaaaaatttctattaaaattaatgaatttagcaagattgcaggattaaaggccaatgtacaaaaattagttgtaaaggaggccaggctctctcacaaaatctaatgatacgtgccacatccaaggttctgaagagcaaacagaccacaggtttacctccactacatctcatcagaacaacgcttgctggcatgggaagccagcccagccaccccacccctgcctgagctcttgggctactagcagctctgcatttccctgggacagagctcccagaggtaaaagacaggcccctcatttttgccacattgcagctcccacccctactgcccttaggcttggcagagagcaaaatgcttaaagactattgcaggcctccagcacaacatagcttccttacagaaaagaagccatatggttttccacatgggcccctgcctctgctacttgtcactggtcaggatctcccaatctgggaccccagcacagccaccctggccccacctgaactctatcccagcatttccctgggattgagctcctagaggtaaaggacaggcctgccatttttgctgctttgcagctcttacccctactgccctcaggcataacaggaagtaaagagcttaagaatgatcatgggcctccagcacagcacaattgccttatggaaaggtaaccaggctgctttccatatgagtccctgcccctgccattcctcactggtcagggtgtcttgacctgggcccccagtaaagctgccctgcccctgcctgaacacttgttggtggtggctgtctgtttctttgaggagaaaatcccagagtcaacccacagcccctctaccattgcagctacagcagtaccgcccttcctgtcctcaagctgggaaagaaacaaaggacctgttcacttcactggcacctccagtatgctgcagctgccatatggcgaggggtcaaatttctcttccctgtgagcccccaccacctacttttcaccaggagggccccccagcaagggactgcaatgcaaccactccacccttggctgaacatttccattggcagtggctctgcatttctctggggtgcaactcccagaggcaactgaaagcccctctgctactgccacagcagtggtactgcccttgctgcccttggattggggaaggtgtcaagaccctgagggttctactcatacctacaccacaatatagctgccctatgaagaagaagccagtctgtcttccactcaagccacacacccactgtgttcatcaccaggcatggccccctggcttggacctgcaacacagctgccccacacctggctgattgatccagtcagcagtgagtctgcatttctctgggttggcacctcaagaaacaagtgaacatttttctgccattgtcattgtcaaggccccaccactgctgcccccaaatggaaaggaaacagaaagcctgagcatgccccgtggctgtggtgtgcagcctgatggtgccaaggtgagatctgaagccagcaatgaagtgggataggagccaacactctcagagcacttagaagaagcatggctgcaactgtgaaggaatacaggggagctgtgtggctgagcaagagcctacctactacccatcacacttaagcaccatctacaaggtcgcagcccaaacttcaacaccaaaaattctttcctaatatatccgccctgcaaaatcaaggtgaaaaattcagtcacaaataaagaccctgaacaaagccttgactctctgaaaacatataaaaatgtcatcaactgactatacccaagttatcccacatttatagaagcgtaagccctcacagatgaggaagaaccagcccaagaacctttgaaactctaaaagccagagtgtctccttaccaccaaatgactgcactagtttcccagcaatagtacgtaactaggcttaaatggctgaaatgacagacataaaattcagaatctggatggcaataaagaccatcaaaatttggagaaagttgaaacccattctaaggaatctaaggaatacagtaaaataattcaatacatgaaagacaaaatagacattttatgaaatgaaccgtactgacctgattgatagagctgaaaaacttactacaaaaatttcatgacacaatggggagaattaactgcagaatagatcaagctgaggactctcagagctcaaagaccggttcttcaaattaactgagtcaggcaaaaataagaaaaaaaaacttaaaaaatgaacaaaatctccaagaaatatggaattatgtatagagaccaaacctatgactctttggcatctctaaaagagagggagagagagcaagcaaatgggaaaacatatttgaggatatcatccatgaaaagtttcccaaccttgctagagaggtcaacattcaaattcaagaaattcaggtggcctctgcaatatactatacaagacaaccatccccgacacatagtgatcaaactcaccaaggtcaatgccaaagaataaatattaaaggcaactagagagaaggggcaggtcacctaaaaagggaacctcatcaggctaacagtgaacatttcagcagaaatcctacattctagaagagattggggacctatattgagcatccttcaagaaaagaaatccgggccgggcatggtggctcaagcctgtaatcccagcactttgggaggccgaggtgggcagatcacgaggtcaggagatcgagaccagcctggctaacacagtgaaaccccgtctctactaaaaaaatacaaaaaaattagctgggcatggtggcaggcgcctgtagtcccagctactcgggaggctgaggcaggagaatggtgtgaacccaggaggcagaggttgcagtgagccaagatcaggccactgcactccagcctgggcgacagagcaagactccgtctcaaaaaaaaaaaaaaaaagaaaagaaaagaaatccaactaagaatttcatatccagccaaactaagctttttaagcaaaggagaaataaaatccttcccagccaagcaaacgctaagggaatttgtgatcaacaggcctgccttacaaaaggtccttaatgtagtgctaaacatagaaagaaaagaccattactaaccaccaccaaaacacactcaagtgcatagaccatcaacactataaaccaaatacacaatcaagtctacctaacagccagctaacaacataatgacaggatcgaatctacacattatcaatattgaccttgaatataaatgggttaaacatccgcacttaaaaggcacagagtggaaagttagataaagaagcaagacccaactgtatgctgtattcaagatacccatcttacacaaaaggatatttataggctgaaagtaaggggatgagaaaggtctatcaggcaaatggaaaacaaaaaagggcagaggttgctgttcttatatcaggcaaaactgacattaaatgaacaatgatcaaaaaggacaaagaagggcattacataattataaaaagttcaattcaacaagaagatgtaactaaatatatatgcacccaacactgcagcatccagattgattaaacaagttcttagagacttacaaagagacttagataaccacttaataatagtgggatacttcaacaccccattgacaatagtggacagatcatcaagggacaatactaacaaggatattccagacctaaatttgatgcttgatcaaatggacctaacagacatctacagaacactgcacccaacaaaattagaatatacattcttttcatctgtacatggcacatactctaaaattgaccacttgctcagccataaggcaattgctaagaaatttttttaaaaagccgaaatcatatcaaccatactgttagaccacagtgcaataaaaatagaaatcaaaaccaagaagttctttcaaaccatacaattacatggaaattaagcagtatgctcctgaatgacttttgggtaaacaatgaaatgaaggcaggaatcaagacatttttgaagctaatgacaacaaagatacaacataccataatctctgggaccaagctaaagcagtgttaagaggaaagtttatagtgctaaacacccacatcaaaaggttagaaagatctcaaaataacaacctaacatcacacctagaggaactagaaaaataaaaacaaaccaatcccaaagctagaagaagacatggaataaccaaaatcagagctgagctgaatgaaatagagatgagaaaaaccacacacacaaaaaatcaatgaactaaaccttggttctttaaaagactaaataagattggtagactactagctaaactaataaagaaaaaaagatgataaagataaatgaaaaacgggacattaccactgactccacagaaatacaaaaatccctcagagattattacaacacctctccacatatgaactagaaaacctagaagaaatggataaattctcagacacatacaacatcccaacattgaacgaggaagaaattgaaatcatgaccagacaaataatgagttctgaaattgaatcagaaataaaaagtctaccaaccagaagatgccctagaccagactgattcacaggtgaattcttccagatgtataaataagagctggtgctgatcttactgaaaatatttcaaaaaattgaggagaagggactcctccttaacatattccatgagactagtatcattctgataccaaaagttggcagagaacagtgaaaaaaaaattcataccaatacccctgatgaacacagatgcaaaatctattaacaaaatgcaaacaaaccaaatccagcagcacatcaaaaagctaatccactatgctcaagtcaaatctattcctgcaatgcaagattggttcaacatatgcaagtcaataattgtgatttgtcacataaacaactaacaacaaaaaccacatgatcatctcaaaagatgcagaaaagcgttttgataaaattcaacatcacttcatgttaaaaaccttcaacaaactatgcatcaaaagtacatacctcaaaataataagagccatctctatgataaacccacagccaacatcatactaaatgggcaaaagctggaagcattcccattgagaaccagaacaagataaggatgcccactctcaccactcctatttaacataatactggaagtcctagccagagcgatcaggcaaaagaaagaaataaaaggcatccaaatgggaagtgagaaagtaaaactatctcccttcacagatgatatgataccatacctgcaaaaccccatagtctctgcccaaagcctcccagatatgataagcaatttcagcaaagtttcaggatacaaaatcaatgtgcaaaaatcagtagtgctttagacacccataatgtctaagctgagagccaaatctagaatgcaatcctgctcacaatctccacaaaaataaaatacctaggaagacagctaaaaagggaggcaaaaaatctctacaagaattaccaaacagtactgaaggaaatcaaagacacaaaaacatggaaaaacattccatgctcacagataggaaaaaatcaatgttgttaaaatgttcatactgcataaagcaatttacagattcaatactattcatatcaaactaccaatgatatttatcaaagaattataaaaatacattctaaaattcatttggaaccaaaaatgagctcaactagcaaaaccaattctactctgatttgtatgggtgtcgatctctgtgtttatcttccttgcagttcgttgatcctattagatgtatgtagacgaatgttttcaccgaatttgggaggatttcagccattatttaaattaaatagtttttctgctcattttcttctttctggtagttccattatgtatacgttagtgcacttaatggtggcccatctttctttgagtttcttttcatttttgtttatgtttttcactctgctctgcagattgcataatctctattaatctatttccaagttcactgattctttcttctggcaaatcaaatctactcttgagttgctcttgctcctcacccactgttggaacatacatatcttgaagaactccccatttcccaatggccctctgaggcatgctgccctcttctctcaaatatctgtaagtaataaaaactgcttcttatttcatatatcctttttttttgtgctgcctcttctgtgtctcacctgaccatcacacctgaatctaattctcctcctagttagagctttcctagagagtggctatcttggtaggaataaactggacacagatcagagaagagccacaagggcatcttccagtataaacatgtttcttatcagaaggacacctgatcatggtcaagtgggttggacacttaggcattaggctgtcctccaggataaagaggtatcccataaaaggtacattgtaaacatccaggacaacctcccctggagtcttgtcagcgcagagcaaggatttgtggccactctccagagagagaccccaagaccaaattttatatatatatgtgtgtgtgtgtgtgtgtgtgtgtgtgtatgtgtgtgtatatatatatacgtgtatatatatagcaattgatgcatcaagcagagtggtcatgaccatgagggatacaacaaaatgcctttagactgcttttggcctgttagctggccctctcacctggctaacaccatttgagaaggctccatggcttgctgatgtgtgtctgtgctgctgcatcctactgcttattgtctttattaagtaccgccaaaactcccctccctaaattgagtgcgtcctagaaagttggagttctctccaagaaccaacaatcacctgccttagtacagcaagagaggcaaccatgatcgctatcactctcctgaatgggaactactagtcacagttaagttgactgtattctgaaggccttgcccagattcgaatggcttattactgagaggttaaagggagtaacctgtgctaaggggctgtcaggaagatactgggccagtgtaagccttagcagatggcaagaggaagatatactctgactacccactgaattggtgaggcagtatctggggctagactttccagtatgacaagaggggtgcctacttcactggggagatgacagcatctcactggcagcagtggcactgtgatctacaatcgatatgtttctgtcttctcttccttctgtcactcttgatccccttaccctatgtgttaccctattggtttaaccccattgtgtgtgatgacaaagaacttaatgattcaaattaaaaggccagaacatttctttgccaactctcccatgatctctgaggaggttagcaaactattaaagaaatagggcttggggccttgccaagtgatcctgccactgttgcactagtggaggctgatccaaatccagatgatgttgatcgggatgccttggagagcaaggcagctacctacaacaggaccaatgaaaaccacaaatggaggccactggtcacaacaggagccacttggaaccaccaggagcttgttaggcaaacatccaaaaagagagagaaaagagaatgtttttagtcacctagaaatacaagccattctaaagattttacttaaaagaaaagaatggtggaggctcattgtcctgttgtgggaggttgtcccagggaaagggacctggagacaccaggtcccttcctcctccctgtattcctctaataaaccagatacagaaactatgaaccacagtgtcaggaggctaaaaacctaaaacaaaacaaaacacaataaggaaaaaatactgctgctttcagtggcttcaagttgaaggaaaaaaacaaagaggaacttcaactttaagaattgaggaaaatcagctctagcaagcaaaatactagccctagattacttatcgatttataaataaacccctaataaaaggggataaaagatacataataaattatatatacatatattttgatatcaatgtatgataaattgtgtatatgtgtatatatgatatgtaactaaaagcaaaattccacaccttgattcaattaaaaattcaaaatttatataacaaaaaggtttaggcaaggcatggtggcttacacctgtaatcccagcacattgggaggccaaggtgggaggattgaagccagcctgagcaacataagcaagatctcatctctacaaaaaatttaaaaattagctgggagtggtggcccgtgcctgtagtcccagctatttgggaggctgacacgggaggattgcttgagtccaggagtctgaggctgcagtgagttaggatcatgccactgcactccagcctgggtaacagagtgagaccctgtctaaaaaaaaaaatgtttaaaaagggtgctgattggtttttgtgcctctacaacatagattataacttaactttaacaactggtagaatggaccaaaattgaaaaaaatctatggatttaatcaatactagggctcaaattatacctgggcacctcaataaatttaaacattgtgccccctatattcttaaaatggtaactaaatataatagagaaaaatagatatgccttaatttgttgccttgcctaaatttctcatagtcatagtacccaatgctgtaacatataccatattggaattaaatgctctgacacaacaaataatgaattaaagtcaaagcaaatctttggctgttaaaaactggcttgatggaatgggattccatgaacacccagttaaaagacttcatatggcccaatgtaagctaaaatgagggctgcaaagcttaaaacttattacatgaaacccaactaataaagaagtgattattctcaatgcttctccatttagcagaccattttgacatttgattgctcttaaatctgaaataaataaatttaaaaaggggttctcaagatggcttactaccaccttaatgatgtggtcccaatcatcaaggctccctacccaatatgtgaaattattaatattaatgattctattctgtcaacaatcagtaaatattttgttcttatagattggctaatatgttctgtttaatgcctgtttcaacagtctctcagctgcagtttgcttccacctccgaaagggacacaatacaccttttctaggttactgatggggtaccacaatagctttttttttttttttttttgagacagggtctcactctgttgcccaggctggagtgtgatggtgcgatctcagctcactgcaacctccgcttcctgcgttgaagcgattctcatgtctcagcctctgagtagccgggattacaggtgtgtgccaccacacccagctaatttttgtatttttagtagagatggggtttcaccatgttggccaggctggtctcgaacccctgacctcagatgatccacccgtcttggcctcccaaaatgctgggattacaggcgtgagccaccgcgcccagcccacaatagcttttttatcacatgcaatctttggagataagaccctgatggcatgtatctttctccaggaataaaggtctgatattacatgaatgacatcctctttcaaggagattcatgtgacacactcactaagtacatataagtccagtatgttttttacttataaattaaaattgaccatcactcctattagtgctttcaaaaaacctcattcacgacaactttttcacgccttctggagtctgtggatcactcctgatggccattagttgctccagggcttctaatgcaacatattgcccctcttggccttgtgctatgcaccattaaaacaacaaatacctgcctacatactgggcacatttggaaatagaagatctcatagaccttgagcctgtgaccctccatacccagctgctcattatgctttgggtcatggaagcagcacgccacaagctcagcctggctatgaaggaagacctcgttaaaacagggtggagccaaacttgggtggagcccatcttaggatagggcccaagaaacaacacacttagccaaacctcaggcagtcatcttagcattggatgccctgatcaacaaatggtcctgaccaggaatagctcacacctgtaatccaagtgctttgggggacagaggtgaaaggatcacttgaggccaagaattcaagagaagtctgggcaacatagtgagaccctgtctctacaaaaataataaaaataaaaaaaattagccaggcatggtgctgcataccagtagtcctagctactcaggagactgagacagagatcacttgagcccaggagttcgaggttacaatgagctatgatcatgccattgtactccagcctgggcaacagagggagactctgtctcaaaaaaaaaaaaaattaaaaacagaattactatatgatccagtaattccacttctcagtatatattccaaggaagtgaaggcagggactcaagcagatatttgcacacccatgttcatagcagcattattcacaatacacaaaagatggtggcaacccagtgtacattaattgattaataaataaacaagatgttgtatataaatacaatggaatattattcagccttaaagagggagaaaattttgacacatggatgaaacttgaggacattaggctaagtgaaatatatcaataataaaaagataaatactgtatacagttatatgaggtacctagagtaaattcatagaaacaaaaagtagaggggtggtttctagaggctgaaaggagggagaaatgggagtcttgtttaatgagtatagtgtttcaattttgcaaaagattggttgtaccacaatgaaaatgtacttacaactactgaactggaaacttaaaaatggttttaagatagtaagttttatattatgtatattttaccacaatttaaaaaacctaattaataaagaggtgattatctccactgcttcttgatttgatagccaaattttcttgttcttaacaagaaaattaaaaatatatttatttggcatagatacatagatacaaaaatacacctgatggcatctcaggatggattattacaacctgtggtctcatccattaaggcccccatacgaaatacccaatattacgaaaattactgactctatccaatcaacaactgataaatattttgctattacgtatttggctaatatgttctgttcagtgcctatttcaacagcatctcaccacagtttgccttcatctccaaaggaacacaatactcttcttcaggctacccatggggtacctaaacagctttgccattgcacacaatctttgcagatgagagcctaactactttcaccttttaccaggatcacaggtataacatcatcctccaaggagattcatttgatacattcatttagaatctacaagtccaacatcttttaatcctttttgagttctgatggcaacgcattcctcatttacaaatagaaataggctgctccacaagggaagtgtctgagttagttttgtaggatctttctacagggaagggttacatcagggcatgtataggagaggtttttctagtgtttgtgcagtggctcaacatgcttcttcatacattgtatgtagcattagcattttaaatcacccttgggcatgatttttcgcattaaaaatgaggaagagttaactataggttggaatttaagtatatctgcacatgcaggtactccagggaagtctctagccccctgaaacagaaacttgcgataattatttcttgggtcttttgttactgactggttgagggtcacataagctagatcttgagtgagaggtttttatcctttttctccagaccatattaaaacaggaaaccaaccagcctgcctgtctcaagaaggaaggtaccaggctctttttaacaacgagctctggtgggaaataatcgaacaagaacttactcacacccaagggagataacccacacaccacccactaagcctcacctctaacattgaggatcaaatttcaccatgcgattaggatgggacaaacttccgaactatagcagtctcatatataatgtgtttttaagtacatggaggttacatatatacgaaatctaggagaggttactactatctgtacctctctaaaaattaatggagatcattattttccccagaaggacctgtcacgtatcagtcaactccttgactccctagagaggggaccactcactctactgtgccctctccttctccacctccagcgttacatcctgcccttcttctccaatcactaccacagcaatcaccctttccccttggtcacacaaaaataccactaatatctacatatactttactaacttatcagttcgtaacctgcctgcagcaacataactgtttgactcttcactttgactcaagaaatacaccaagatattactgtttatatatacgtatatatgtgtgtgtgtatctatatctgtcatacacacatttatatgtgtatatgtgatatatatccacatacgtatgtatatataaatatatatatatcatacatatatataaactttaacacactttacaactccaacaagatattgttagagatctcagaaatttcagatctactttttttggttaatgccatataaatgagaaacttaatcatggtccagcctataaagactcttatatttaatacttctacttgcattcctttcttttgattcccattataaaatgttttctaggccatttgggaaaacatatgtcctaatgtatagtctctatcatcatcccaatatgtttttaatatgatatcaaagtatcacagggccaattgtattcaattgtattaaccatgtctttaattttctatattctgatgctttgacatcttgaggcagtgctgaccttggaaggattgctcctcccaggattagccaatttctagagacagtaaacaactggattatgaaagtgtctttcatatgcaaaccaaccactccagagtccatatcctccatcacctcctttattggcttctcaggcacaggaccactatttacctgcccaaatcacccccgggtcgggtatcagacaactaggaaaagcccctaagctgtagagcctgctaaaattattcaaactagctaattctaaacctgcttactttaacttgcctattccttccctcagaaaccacaataaaggctctcgcccacattcttccctcaccctctgcctcctgactgacactggtgctttcctgggtgaaccctgacggtgtggcatgcctcttcttgtgatctgtgagtataacagtcttttcaatggcagagatttcctgatttgttggtcttacctacttaaataataataaaagccatattttaaaacactaccccaaacagacaaaagctctgtggggtaatttatttgggaactgatcccaagagtagaaatgaagtatataggagtattttaaaaaggaaggaaagccagtacaaggaataattccaaattttagttaccatgcaactgataacaggtatatgatcttggggaccttctgagttgcattatgaaatatatctcagaactgtctagttgaaggacataagagggaaggatttagccaacacctcccattcccttattagtcaagataatcccatgtaacctaattctgccacacatcctatttgcacatgtctgactgcccactggtctgtaatttgcccagtgatttggcatcagagaagcccctgtgcaagaagcaagatatacactgcactgggccagtgcaaggccttgtcagattatgcttgcatagaactggtcaccacagcagtgactcgattaagagaagacatgatttgacatgcacacaagctgtacccaaagcaccttacaggtacttgttttgcattttgttaatatatctcttaagcctctttaactctctaagttccccctcgttctcttattttttttattctttgcaaattatttgttgaagaaatatagtcaattattgtttagacttttccagagtctggattttgctgattgagtttcaatgatgtcatttaacatgttcccctggctctatgtttcttacaaaatataagctaggcagggtgacacacacctgtagtccaagctactcaggatgcaaaggcaaaaaaatttctttagaccaggagttcaaggctgcagtatgctatgatcacacctgtgaacagtcactgtgctccagcctgggaaacacaatgagaccccacccataaaaaaaatttaaaagtacagatgctttgtttaacttgaggtacagtttgtataggaggtcaaaataaatgcttctctctttacctttttgaaaatcagctttccaaacaattgttctctatcatcttccaaaggacatttattaatttgcgagggctgtcataacaaagtaccacagactgggtagctttaaacaacagaaatttattttctcacagttatggaggctagaaggctgaagtcaagttgtcagcagagttagttcctcctgaggggccaccagggaagaattttcaggtttagagatggccatcttcaccctgtgccttcacactgtcttcactctgttcctcaaaactctaccagcacctacatattactcaattcaaaaggcacttctatatttttaaagcagcaccccacatttcagcaccaaaatcttatataaatgtcatctaaatcagatatgagtgacttgaggtatgattcaacctgaggcaaaattcctctccatctgaaaacctgtaaaaccagacaggttatctgctttaaaaatacaatagtagaacagacataggatagaaattcctatttcaaggagaaaaaatgagaaaaaaaaggatcatggattgcaagtaaattcaaatcagaacagggaaaattccattagattttaaggctcaagaataaatttctttggctcagtgttctgtcctctgagcccacccaggtggtggccaagccttctcagctctggaaagcagccctactcacctcagccctagaaaacagacccacaccctctggcactcacaagcagatgcctggctagatgaaatctggaggatatagccacattccctaggcctatgcctctgggcccaagggagaagtaagccctgctgacctctgatctacctttgggttattcttctcttttcttgaaggataagacatgtttacagctggatagcgctattggcccattttgtagaattccagaagtccaacagccttccttcattttatcccgtctctgtccccttcagtccaagctagcagcatttctgctggtacaaaattctcaaaacccttttgggcctcctgtgcaattcaaagggggtacaaaatcagatgagagtcgttgacatatatttcctagacaactgcctgtctattcctggattctgctgagctgttcattggatctatgaattgcacatgtaatatctttagtaaattgttttccagccatatccttgatgttctctccagaacacattttctaagttttgcaatatgaataggatgagaatttcccaaatcttcaagtctggttcctttttacttaacaattcattcctcaaattaattctcttctctcacattttactataaagcagcaaaaagaagccaggtcaggtctttgacacttggcttagaaatctcctcagctaaatatccattcatcacttacaaattctactttccaccaaacactagaacacaatttgtccaagttctttgctactttataacaagaataacctttcctcccgtttccaataacatgttcctcatttctgtttgagaccgcaccagaagaaccttaaacattcatatttttaccatatgatgttcatgatgatatatatattccataagatgacagaagctttctgtctttacagctcttctcttttctttctgagccttcaccaaaatcattttaatgttcatatttctaccaatagtcacttcaaaggaatcaaggcttctactaacatgcttctcattttattttaattaccttttcaaaaatcctaactttaattattgtcacattcaggttttgagggttaggacttcaacatttggactcttttttggagacagagtttcagtatgttgctcaggctagtgtgtagtggctattcacaggcatgattataactcactacagccttgaacctctggactttatcctcctgcttcagccttttgagtagctgggactataggcatgtaccactgagccaaacttcaacatgtgaatgtttttgggagacacaattcaaccaacaggaacattactttttttgcaaatatcaatatgaaatctctgtgtgagacatattttatgcttacagttcattgcagttatgatttttattgatgctcagattgtcccatatttggcctgtgagattttcatcaaattgacttctgagtctctttgacatgacccaatggtctttgatatatatatatatatattttttttttgagatggagtcttaactctgtcgccaggctggagtgcagtggtgcaatctcagctcactacaacctccgcctcctgagttcaagcgattctcctgccccagcctcccgagtagctaggattacaggtacttgccaccatgcccggctaatttttgtacttttagtagagatggggtttctccatgttggccaggctggtctcgaactcctgacctcaagtgatctgcctgccttggcctcccagagtgctgggattacaggcatgagccaccacgccccgcctgacactttccttgtattataaaaaaaaaaaaaacttgtggggggagatttcctttccttttctccgaaaggggaagaaattgaaactgagtggcccatgatggaaagaggggaagtccaggggtgcagaaggcccctgggtgaaggcagaggctaacatggggttcgtagctatgggtggccatcagcctgaccaactttgtgctgtctgtcatcactatcatcatctgcttcacctgctcctgctgctgcctgtacaagatgtgccgccgaacacgtccggttgtcaccagcatcacgttcaccactgtggtgcacgccccttacactcagcctccaagtgtgccgcccagctaccctggatcgagctaccagggctactaccccatgctcccccagccagggatgacagcagcaccctacccaacacagtacccaccaccttactcggcccagcccatgggcccgccggcctaccaggagacgctggctggaggagcaaccgcgccataccccacgagccagcctccttacaacccggcctacatatatgccccgaaggcggctcccggagcgtgccccggcctctccggctgccactagattatgttgtgtgtgtgtgtgagtggtgtgcaagcacggttccttacgccccgtgcgtgctgtgtgtgtcctgcctgtatatgtggcttcctttgatgctgacgaggtggggaacgttccttgccagagtgggctgggaccagactttcttctcttcctcacctgaaattatgcttcctaaaatctcaagccaaactcaaagaatggggtggggagcaccctgtgaggtggcccctgagaggtggggggctctccatggcacatctggagttcttttccagcttaccctagggtgaccaagtgtggcctgtcacaccaggatggtgcagctttctgtgagtatgatacagatgtgtcctggttttggcaacgtagccagctgctgctcaggggcatggtttgtccccagagttgggggtaccctttgcagagccagagacatgatgcaggtgaagcttgggatctgaccaagttgggctttgatcctttgggcagatgtcccattgcttcctggagcctgtgtcatgccgactggggatcaggcagcctcctgatgccagaacacctcaggcagagccctgcttacctgatagctgtctacctggactgttcctgtccctacatcctccctaggaccacctggagggccacacacacagcctagctacccacagggagctctcctgcccttgctggccctgcccttcccacaggtgaacagggcgctctgtccaccagcacactcaggtctcttccctgcagtgttttcattttattttaaccaaacattttgcctgttttctgttttaaaatgtgatagttgatgtgagactgaaacccctgggttgtggagggaaattggccaggagaagagggaaaacctggcaactgtgagtccctgcttcccctgacaccagcctcatggaatatgcaactcctgtaccccagtccagtgtgttctggcagcagggacacctgggccaaggggccatctggaccaaaggtggggtgtggggtcctggatggcagacatgaatacctcggtattccctgtctctcagttattgtttcaccagagctgtctcagcttcgtatctgttgtgtttctgagagtctagagtctgcacccttgtttataataaatgcaatagtttggaaaaaaattgtgggcacatagtagaggtatgtatttattgggtacatgagatgtgatacaggcatacaatgtgaaataagcacataatgaagaatgaaatatccatcccctcaagcatttatcctttgagttacaaacaatccaatcacactctttaagttgttttaaaatgtacaattaagttattattgactatagtcaccctgttgtgctatcaaatagtagttcttattcattctttctgattattacttgtacccatagaacatccccactgcccccacatgcccccactacccttcccagcctctgataaccattcctctactctttatctccatgagttcaattgttttgatttttagatcccacaagtaaatgagaacatgaaatgtttgtttttctgtgcctggcttatttcacttaatgtaatgatctacagttccatccatgttgttgcaaatgactggatctcattcttttttatggctgaatagtactccattgtgtatatgtaccacacgttctttacccattcatctgttgatgaacacttacgttgcttccaaatcttagctcttgtaaacactgctgcaacaaacataggcacacagatatctctttgatatactgattttctttcttttgggtatataccaagcactgggatttctggatcatatagtagttcaatattttttgtcttcttaggaacctgaaaactgttctccatagaggttgtactaatttacattcccaccaaacagtgtacacatcctagccagcatttgttattacttgacttttgcatataagccattttaactgggtgagatgatctcattgtagttttgatttgcatttctctaatgatcaatgatgttgagcacattttcatatgcctctttgcaatacgtatgtcttctcttgagaaatgcctattcaaatattttgcccatttttgactggaattactagattttctccagtagagttctttgagctccttataaatcctggttatgaatcccttgtcagatgggtagtttgcaaatattttctcccattctttggggtgtctattcacttggttgatagtatcttttgctgtgtagaagcttttaaacttgacgtaatcccatttgtccatttttgctttggttgcttgtgcttgtggagtaaagactgtgttttcccgagtgcatattcttggcacctttgtcacaaatgggttcactgtttgtgtgtggatttgtttctgggttgtctgtactgttccattggtctgtgtgtctgcttttatgccagtaccatgctgttttggttacaacagctctgtagtattatttaaagtcaggtaatgtgattcctccagttttgttctttttgcttaggatagctttggctattctgggtctttgtggttctgtatacattttaggatcatatttctgtgaagaatgtcattggtatttttatagggattgcactgaatctgtagattgctttgggtagtatggacattttaacaatattgattcttccaatccatgaacatggaatattttttcatttttggtgatctcatcaatttcattcatcagtgttttatagttttcattatagagatatttaacttctttggttaattcctaggtatttaattttatgtgtggctattgtaaatgagattactttttaatatctttttcagattgttcactgttggcatatagaaacactactgatgcctcagagatgaccatgatggtgttctggtgtcaggagaatagcaatgcctgggagtccaccaccaccataatctcctgtgatcccacggagctgcagtcagaagggagcaatgacaagaaataagtgctgagcagttgtcatatggtgctggaagacatgctacttttccctgagggcggaagacagcctgatgacggtggtacaatcaatgacatctctgtgctgggagtgacctgcttgggggcccaggctgatcatttcacacagacacccctggatcctggaagccaagtcctggtctgggtagactgggagtggaggtttgaccacatgcagcagcattaaaggcagcatctcatcacagcagttgctgattatctgtttgagttaaagacaacatcatgggagttagggaaatttcggagtgtgatgctggaaagcccctctgtgaatgcagagaaaataaccgccactgaaaagagtgtcaataaaaatatcagagatcagctgctcaacaaagtatgagaactgagcctgaatgatcctgaggcggagcaggtgagaggctggggcctgccagatgatcatgctgggcccattggaattgttaccatcaagggtgttgattccaacatgtgctgtgggatccccatgagcaatctccgtgactttccagtcattaagattaggcaccgagaagaggaaaaggaataaaatcaaactgatatttctggctgggaaccagatgctgaaatggatgaagagaagtcatgaaactgaaagagcactgaatcactctgcttaagtgtggagcagaggatcacatggaagcagtgaaaaagctccagaatgtagccaggcatggtggctactgcctgtaatcccagcactttgggaggccgaggcgggcagatcacgaggtcaggagatcgagaccatcctggctaacacggtgaaaccccgtctctactaaaaatataaaaaattagctgggcgtgtggcgggcgcctgtagtcctagctacttgggaggctgaggcaggagaatggcgtgaacccaggaggtggaacttgcagtgagctgagatcacgccactgcactccagcctgggcgacagagcgagactctgtctctaaataaataaataaataaataaataaataaataaataaataa

SEQ ID NO: 1689 - DNA, 29452 bp, Homo sapiens
tacaaaaactagctggcgtggtggcaggcacctgtagtcccagctacgtgggaagctgaggcaagagaatagcttgaacctgggaagtggaggttgcagtgagccgagattgcaccactgcactccagcctggtcgacagagcgagactccgtctcaaaaaaatgaaaaataaaaaatgttaggtaagttaatgattcatattttcttgaaaatatggaaagacgtatcataagagaagcatttttgcttaattcaccaaaaagttactgggggctataaattgaacacagagtcttacaaggcacaggaaattttttagacgtttataaacatatcttttgatgcagaggagtatgacagggtgatcaataaaagcttttcaagcaaaaaattattacagaccatatgacatcccagaaaagacaaaactataaaggcagtcaagagtcaatggttgccaggggttacgagggtggggtgatgaataggtggagcacagaggattcttagggcgtgaaactactgtatatgatactacaatggtggatgcctgtcattgtacatttgtcaaaacccatagaatatacaagagtaaaccctgacgtcaacgaggtggggaggttgtgcttgcgtaggggcagggagtctatgggacctctgtacttaccacttaattttgctgtgaacccaaaactgctctaagagataaggtttattaattagacatactgtgatatatgtatagcagtagaatatttatgttactggtatttaatatgatatatggagagagaccagtagaataatatggggaaagtaaaatggaactataagttcgtagagcaggaggaaccatttaaaaacctagactattgaggaagagcttgcttatatgttattcaaaaggataatggaagctaggtgcagtggctcacgtctgtaatcccagcacttggggaggctgaggcgggaggattgcttgagcccaagagttcaacaccagcctgagcaatatagtgagaccccccacatctcttaaagtaaaataaaatttaaaaaaaggataatgatgagtattgagatgctgctagtgtttagagtctactggaaacattttaaagagtagtaaaaacttttattatttcaatgtctacatttacaatatggtagaaattacattctttgcaataattaaatgtatgataaaaaatttagattaaacatagacagaggagggaaaacagcttttcaaaattgtttttgaacgtatacacaacagaaaatttgaagatgggcactcaagcacataggacatttctacacaaatggtggctccagatagctgaagaagcttaagcagctgtaggagagatctccaaatccagggacagtggctgccatcagagtggtccgtttgtgggaaaatgggtcacagacatagaccatatcaggctatatttcacagaaaatcttcttctttttgttactttctgatgaactatatgctatatggaaggtaccattgagactccttgtgatgaaaataactctacttgaattgggggtaaactaaaattagaagggaaagcagaccccttgtccagccaggttgaagaaaatctaagccggtacagggtgaggttgagagagatggcagcgagaatctggaacacaggcctttcctaaatcaaactttcagcacaggtcattcaagggcgaatttcaaatctatgctatgtttataaattgtgtactctacgtaattgccgggtccctggaattccctactctgtgcgaaactaatctcttactctctaaaacaaacccaagtcctaagcccacaacccctgtttgctctttccttcctagtcatcagaaccctcatgactcagactctccaaggaggcatttaaaaaaatgttctcggaccagtcagctccactcgagcaacctgctcttaactcattaattttcccgacatgtcccttatgatgactcgtccatctgtttttcaaattccacatagctgggcctctgtagctttgtggttttatattccgcatactttctaacagtgacagctccagaatttctatgtcagatgaagttgggaacaggcagtctggttggaggaagatattcaggggccagactcaaagtcctgtttggacatgacaacctccttttataatggcgaagagcacaggctctgcagctggactgatagtttaattcctgactccatcacttactaactttgtgagtttggccaaattacttgacttctccatggtttagtttccttatttgtaaaatgaagacaatggtagtactgtgtctcagagtcgttggatgccaatgcaggatcccagtgaccagatggaacgagagggagctcaggagagaccagcttgaagggccgaagtcttgttcccacattgccagtaggaggcataaattccccctcagaggacgtgcaggaaagaagtggaggggagagcccttgaaatggggggaaaacagtcctgagaggggcattaaatttcatatggccaagtatttacccaaaagagacctgaaacattgttttctttttctttcttttttttttttttgagacggagtctcactctgtcacccgggctggagtgcagtggtgcgatcttggctcactacaacctctgcctcccgggttcaagcaattctcctgcctcagcctcccaagtagctgggattacaggcacccgccactacgcccagctaatttatttttatttttatttttattagagatggggtttcaccatgttgatcaggctggtctcaaactcctaacccgcccaccttggcttcccaaagtgttgggattacaggcgtgagccaccaaaatttttttctttcttattgtttttaattctccccccaagcttactgaggtaaaatagacaaaaattatatgttttcagcgtgtacaatgtgttgatttgatgagtatacattgtgaaataattaccactatcaaactaatgaacacatcaccaacacatatttaccatttcttttctgtgtgtgttagcaaatttcagatagacaatacaatattgttaattatagtctccatgtgattaaagttccagaactcattcttcttataactgaaagtttgtacccttgactgttgtttttaatctttaaattgaggcttaaaatatatgcagtaaaatgtgcagagtggacacataagtgctcaagtcgttgaattttatttaattctttaatgtatttattttaaagaaatagagacagggtcttgctatgttgcctagactgctcttgaactcctgggctcacacaatcctcccacctcagcctctcaaggtgttgggattacaggcatgagccaccgcacccggccaattgttgaatcttaacacatgcatacactcacctacccgctttccagatcaagatgtgccacattcttatcaccccagaagcctcccctgcctcctccccatcagtgccaccctagaggtagccagtattttgactttaatcatcatcagttgatttttccatgtacttgactttcatataattagaaccatacagtatgccttccaaaagagacacttttaaaagaaaatgaaatttcatcaccaatatttggcaagcttatacccgtatcctcatttccaaccccaggcttccctgccattggtgggaaagagagtctggaaactgagttgggtgagttatagcaagccaaactacatttttccttgcatatctgaattacacggggtaaatttcaatcaactgctagttgtgagcctagaaatagggacgcaggtgagtcagggtccctgacctatgcttaagagccattgccaaagattgactcagggaaatgggtagttccgtgccccatcctcttccctactcacttccgcttgatactagaagtgagactcactcagtgtccactttccccacccttggagagctcacagggagtggagtgtatcactcacgtagccatgtgctgctctgcagctgggaaggagcactctggagaaagccgggcgtgtgtcctgatgctcttatcaccctccaaatccccagcttcccctagatagactgctattgacctttaccatccatttgtttccttttcttctcttcttccttctttcttctacaaaggcctcctgctttgaaaatgaggcatacccagggaaaacaggtttcaggtcagctctggttcaaagggtgggtcccttccactccgacaagtttgatcccctcattctgcctccctccctgcccctcctcatgtgtgcgccctctggtcttgccgactctgctctctcctccgccttgattcctgtagggtacatctctccaaacggccctgcagaaagcacagcgcagaaatgcccctccctggggagggaggacccaaagttctggcctcccctactcagtatcagctataaatgccacagacacgtttgcgaggaaaaaagaagaaaaataagaagccaaactgtggagcaatttgggggctccccccaaccatgccatctgcctacaaggcttaccctggcactggctggcctttgggtctttttgtgcaactttattttctatcaaggcccagggggtttgccccttgtctctctgcctctttgacctatccttcctttggaacccaggcatctaaatgacaacttctatgtgcatcatttagagatgagaagaggaaatatctctcctgctttctggttcctgtggctgcttctctttggacttctgggacccagtaagtgacttagcagttaaggagggagaggggcatggaggccacataagccctgaaggagatggggaatcccctgcccaggcatgactcttcttccagaaacaatgatgattcatttttttttttttttttttgcccatttctgcaaaagccagtactgatcccaattccactgaccatgattctgatgctgtcttagaagcaaatctgtattagtctcccccagctgtggttgtgagcacatgtggtggggcggtggggcggtgctggggaaatggaggggggtgagattttactttcctttgtatcttggataaaagtttttttttttaaccggaaaactctagttccaatagcattcttaattccaaattaaaaccaggatctcagtctaaagtcaagtaaaaatccttcaatccttctttgttttttttccataggttatttgggtacaggtgatatttggttatgtaagtgctttattggtgaattgtgagactttggtgcacccgtcaccaagcagtgtacaccgcacccaccctatctgtagtcttttatctctcgtgcctcccccgtccttcctccctagtgcccaaagtccactgtatcattctcatgcgtttgagtcctcacagcttagctcccacctatcagtgagaacatacgatgtttggttttccattcctgagtaacttcacttagaataatagtctacagtctcatccaggtcactgcaaatgccattaattcattcctttttatggctgagtagtattccatcgtatatatatgccagtttctttatccaccgttgattgatgggcatttgggttccatgactttgcaattgtgaattgtgctgctataaacatgtgtgtgcaagtgtcttttttgtataatgacttcttttcctctgggtagatacccagtagtgggattactggatcaaatggtagatctacttttagttctttaagaaatctccacactgttttccatagtgattgtactagtttacattcccactagcagtgtagaagtgttccctgatcactgcatctacgccaacatctactgttttttgattttttgcttcaacccttcttcggatgctgcctgattccaaatccatgtataatcccctgagaacttccctggtagaaacaaaccggagttcggccactgaggggttggctctgacattggatcagcaatggctgtgaaaggaaacagcccaggggagaagtgaattgggctccgtgtgactccaatgggctgtctgagatagtactgttcactccagtctttgatttcttacatcaacatatcttccctaattatgagacaccaggttaattggctcatccattccattgcctttactgtaggatggctcgtcaagaagtgggaggtgcggttgaaagagaaggtataggttggatgatgtggaggatttggagtgcttcccccttcttcctcagtatgcatctgtttcctgcaccccactctggattcgctccctcgcccgcttcagcacttccctcggcgttctttttcttctctttccccttgccttcaccctgaatgcttcaactgttctctacctacccatgccttccagatctgcccgtcgcctgtcctaatcctgaactccagtcctatctgtctgattttaaacaagagtccccttacctcagaagaaactgtcattcatgtagtcattcaacaaacatttatagagctcctcctctgggccaggcactgctgcgtgctaggccatggtgaggaatggagtgggaaatgccatggtcttgacccccatggaacacttggtctactgtaaaacatagacttaaataatatttcctaacaaaagggagcaagtgtgcaagggctgaaaggcccctcctcttttcctaccactagatctataaagtaaccaacagtgtctcctgtagccccattacagtggattagcaaggaccaactcctccatctgaatgctgggcgccgtctcaccctcctgccgtctcaggggctttgctcagtgcatttctccttcccctcccatctcactttacctttcttgggtcctttccatcagcatccaaacaagctcagttctgtatgcacaagtatcatccaaggagacgattaaaaacttgggtttccaggccctgacaccccaccaagcaagatcttgattcagtaagcttggtgggatggcgtgggttcttcagacagtgtgatcccagaggtccctggaccaaacactgaatgatgtccatcctaacgtccccgcatcactcctcagccaccacctctccctccactctcctcctcacccccattcttttttttttttttggagatggagtgtggctctgtcgcccaggctagagtgcagtgctgcaatctcggctcactgcaacctctgcctcccaggttcaagcgattctcctgcctcagcctcctgagtagctgggactacaggcgcacaccgccacgcccagctaattttttgtattttagtagagacggggtttcattgtgttgcccaggctggactcgaactcctgagctcagacaatctacccaccttggcctcccaaagtgctgggattacgggtgtgagctaccgggcctggcccctcacccccattcttgaaggacttccccacacttgctatgtcacttctcacctcccactcacttgtttattttattttattgtattaggtaatggatgtaagcagttctgaaaaagaaatacttgtagtcctacaaggcttctcataaaacttcagcccctgattcccttgccccaattgcttcttattctgagtcctgcttcccagggttcctgttggcatttacgttcatactgcatttatctatttatttagagacaagatctcactctgtcacccaggcgggaatgcagagacaccatcatagctcactgcagcctggtactcccgggctcaagggatcctctcacctcagctttccaaagcactgggattacaggcgtgagccattgcacccggccataaattctcttactaccattacttctttgttggttgaggttttttgggttttttttcctgctttgggcatgatttattgtcttccttctaatgaaaagaaagatttaggttagaccactccccctacacacttactgtctcacattcccgctcacaattctccccaaatgactgtatcaaatttttggtgttaaactagcatttagtgtttacattatgataactataaattttacctctagtaacatttataactgggtcatataattgcattgtgatgacattataataagtataaatgacctctagtaacatttataactgggtcatataattgcattgtgatgaccatccgttcttgtaatttttgtttttctagatattaataatagcctcatttttaaaatgtccatagttttcttcatatatgtaattaattcatcccaaaacctccaccagaagtatccctgtcttttccaaacacatgaggcaatctatcagtttcacttttttcccttgagcaatcccatttggaagcctctgtccaaccagagcaatcccatttagaagcctctgtccaaccagtactggttgcttgctagatctcttgtcctgcaatctgtattcagcaacattctggaaattcccttttttcccttgtaaattcttatcttttttctggctttatttttccatcttggagcatcactttctctagaagcttcctgagagagagagtttatggtgggaaattattttaaaaccttatgcactgttagggtaatgctaagctgctgtaacaaggagatcccgaaagtggctttgaaaaacaagtttatttttctcccttgtaccagtcctaaggtaagtattataggatggtgggagctctgctccatgcagtcattcagggatcctgggtgaatatggttcttccgtcttcaacatatggtttccagtgtcatcatcatttcagcccaaggagagggaagaaaaacagtattttgtattattttatgatacagtcagtcaaagtgcagccacaagaggagaggcttacaggccctagagacaggaggcatggcactgccatgcgggaccacctgagaaagacatcaaggtagtcaggaggcagaagacaggagtgaaggaaagatttatgtctttccttttattgggtttctgtgggaaaggcaaggaaaggcagggtgaacagtttaggattggctggtttgaataattcctgtgttctttgagctatatggctgattaccacctagttgcctagtacttgactttggaatgactaaggcagataaatattgtttcctggagtatatgggccagatagaggagctatggctctggaatggttagtctgcatatcagctcatgctcctggctggaccctttgctacttttaagaattggctagccctggaaggtcctgtctctccctagctagaaaagtttgttaagatgtcaaaacatgataatatacagaaattaaaaatatatatacaagcagaaatcaaggaataggtatttactcttaaagaaatgaagtggaaattaatatgtattccttcccttcaggggcctctgactagggcttagacatgtagccctacctagctacaagagaggttgacaaatgtaacttagccatgtgcccaggaagaagagaaaaatgggcccagctgtccatagaccttatacatctgaaaatgtcttattccaccctcacatttgactcatagtttagctggttatagaattctaggatggatatgatttttctcaggattttaaaggcgttgatccactattcctagattctagattgtgaagtctgatatttagattactgacctcttgtaaaagacccattctttttattctggaggatttcagatttttaaaactactgttctaaaatctcatgatatggtgtcatagtatggattctttcattgtgttaggaatttgcacagtagaaagttgtatcagtcagttctgggaaattttattgcatttttttctttgataattgcctctcgtccattttctctgttctgtctttctgaaaaaatcttataatttggatgtttgacctcctgggctgacactctaattttcttatatttcttcttctgtcttccaactctgtcgttttatttttcttctggggagatttcctcagcttctaaagtcttcaaatccttctagtgaattttgaggtttttttttttcaaagagatcttttttttctctacaaccatttttaagatggcatctcttacttttttttttttttgtgggtgctatactttctcttatattgctgaggacatttgaagttggttttgctgtttgcattgtctcagttctctctggctttgcttcatagggatatttgttttggtctctatatttcaagctagagatttttctcaaatatctggtaatcccagaatgtcctttgcatttgagtgaggcactaatatgatgcctggaagctctgtgagcaggggtagggcctgtcaactggtggacttagctttagggtaatttagcagagacgtggcagtttagattgggaagatcctcaaaatgtcagtatctagtgttggctaatttctttccacaagaagaattctccagatcctgtctagagcatactagcatagctgctgaagtgctggaagctgagcaagggaataggtaatgtgggttttacatttcagggtgtaagcatttccttaattgcatagtttcagtaaaaccttttgagaggtgacagggtgctggcagccctcgctcagtctcggagcctcctcggcctcgccacccattctggctgcgcttgaggggcccttcagccccccgctgcactgtgggagaccctctctgggctggccgaggccggagccagctccctcagctttcagggaggtgtggagggagaggcacgggcgggaacccgggctgcctgcggcacttgcgggccagcactagttccaggtgggcgtggcctcggggggccccacactctgagcctcgggctggcgtggccagcacagctggccccaggcagtgaggaacttagcacccgggccagcagctgcggagggtgcgccaggttccccagcagtgccagcgggtgctgcgctccaattctcgccggacctcagctgcctccctgaggggcacggcttgggacctgcagcccgccatgcctgagcctcccccacgccgccatgggctcctgtgcagccagaacctcccagacgagcgctgccccttgctttgcggcacccggtcccatagactgcccaagggctgaggagtactggcgcacggcgtgggactgacgggcagctccatctgcggcccaggtgcgggatccactaggtgaggccagctgggctcctgagtgtagtggggacttggagaacctttatgtctagctaagggattgtaaatacaccaatcagcactctgtgtctagctcaaggtttgcaaatgcaccaatcagcaccctgtgtctagctaatctggtggggactcggagaatctttatgtctagctaagggattgtaaatacaccaatcagcactctgtgtctagctcaaggtttgtaaacacaccagtaagcaccctgtgtctagctaatctggtggggacttggagaatctttatgtctagctaagggattgtaaatacaccaatcagcaccctgtgtctcgctcaaggtttgtaaacataccaatcagcaccctgtgtatagctcaaggtttgtaaatgcaccaatcagtgctctgtggggacttggagaacttttgtgtctagctcagggattgtaaacacaccaatcagcaccttgtcaaaacagaccaatcagctctctgtaaaaccaatcggcgctctgtaaaatggaccaatcagtaggatgtgggtgccaccagataagggaataaaagcaggctgccctgagccagcagtggcaatccgcttgggtactcttctatagtgtggaaactttgttctttcactctttgtgataaatattgctgctgctcactctttgagtccacactgcgtttatgagttgtaacactcactgcgaaaatctgcagtttcactcctgaggccagtgagatcacgaacccaccagaagaaacgccgaacacatctgaacatcagaaggaacaaactcaggacacaccacttgtaagaactgtgacactcacggcgagagtccacggcttcattgttgaagtcagaccaagaacccaccaattctggatacactttcactcctgccttcagcagtgcctgggattactgatctagagtttctttggtttcagtatctccagagataaaaccctaagctgttaaaaggaagagaggtgtattcatccaagtgcttgagtggaaggagtgatctggagctgagagacagttcctagctacattgtatttcaactatccttcctgtatttagtcacatgccacacccaaatctttagaggaacccagttgcaattcccgaatctttccaggattccacagaattaataatctaccagtagttgacttactctcacccccaatggaggcctgtatgttgaagctttctctgttgtgttggagagttaccactcatctgcctattaccttcaaaaaaacaaaaatatctcctctgctgttatctctccatcgtttgtccttgtggaggtatgtgttttgttatttctctactttttattcttctatgaaatccgtaagcctccatatatacttattcttttattcattccaattggggtctaccccatcatgcaaatctgttttcaataaactaaactcacttccatattgtctctgaatccaatggacatggcccaggccatatcttacttgatctctctgcaaaaatcaattcagttaactgccatatttttctagagcctctctattctcttgacttccttgattcactttttagagttttctttctgccttagtggatgctccttctcagtctcattcatttgcgtctcctcctctatctgagtgatgcagtggccagagcttggtccagcgccctattctccaacatactctcccagacaagcgatctcagtcagcttcatggctttaaatacaatgtatatttaaatgacttccagtttcacgtcttttgatctgatttctcctctaagaactaagtgcaggtttccaactgccaacagtctcctggatatctaatgggcacaaaaagttcaaagtctaatatttccaacttccacttcatccctattcattcagataaatagaactaatttccaactctgcgtaagccccaaagctagaagttgttcttgacttcttttcgtgtcatccaccacatgcagcctttcaacacttcctattggttctacttttctaatttcaaaacatagcttgtattcatccactgaaaggtatctcccctgctaccatcctagttcaagcaataattactgctcttaattttttcactcttgccctcctacatgcccgttttcacacagcatcttttaaaaacataaatcaattttgttttctactttctcttcccttcctgaatgattaagccccagatcattaggtgaggcagagcaaagcagatatcagggttggacaggaggggagacagcagtggcccagagaaggatataagaaactgaactgggccgggtgcggtggctcacgcctgtaatcctagcactttgggaggctgaggtgggcagatcacctgaggtcaggagttcgagggcagcctggccaacatggcaaaactctgtttctactagaaatacaaaaattagctgggtgtggtagcgcatgtctgtatttccagctactcaggaggctgaggcaggagaatcccttgaacccgggaggtggaagttgcaatgagccgagatagcaccactgcactccagcctgggtgacagagcaagaaactaaattggatgaagtggacttctccacagagtggcagcctggcatgttttgtcagaatcttgtgagggtgagagggagtatggggtggagggagtatgggctgaaaatgaatgaatagaataccagtgattttgtgagacaatgttttgtctgcaatatgtattattgaagttccagaaaaaaagggaaccgaaaacatgtttaaagaaatagtagctgaaaaaattaaatttgatgaaaactataaactcacagatcccaagaactcaacaaatatcaagcaaaataaactttaaaaaatcataccaaagtacaacgtaatcaaataactaaaaatcagtgataaaagggaaatcctagaatgagctagaaaagacacattgtatagagaggagcaaagacaagcataacagacttcctgtgaaaaaccatgacaaccagaagataaagaagcaacatcattaaaatactgaaagaaaaaaatactttatcaacctagaattacacggagtaagaatattttcaatatgaagatgaaatgaaggcttttctagacaagcaaaaactggaagaccttgcctcctggaaattgactttttttttttttttttttgatacggagtttcgctcttgttgccccaggctggagcgtaatggcacgatcttggctcactgcaacctctgcctcccggtgagaggtgacagcgtgctggcagtcctcagagccctcgcttgctctcagcacctcctctgcctgggctcccactttggcggcacttgaggagcccttcagcccaccgctgcactgtgggagtccctttctgggctggccgaggccagagccggctccctcagcttgcagggaggtgtggagggagaggtgcgagcgggaaccgggactgtgcgcggcgcttgcgggccagctgcagttccaggtaggcgtgggcttggcggccccgcactcgaagcagccagcgggccctgcaggccccgggcagtgaggggcttagcacccgggccagtggctgcggagggtgtactaggtcccccagcagtgccggcccactggcgctgcactggatttctcactgggccttagctgtcttcccatggggcagggctggggacctgcagcccgccatgcctgagcctcccaccccctccatgggcttctgtgcggccggagcctccccgatgagcgccgccccctgctccagggcgcccagtcccaccgaccgcccacgggctgaggactgtgagcgcatggcgtaggactggcaggcagctccacctgcggccccggggcgggatccactgggtgaagccagctgggctcctgagtctggtgaggacgtggagagtctttatgtctagcttagggattgtaaatacaccaatcagcaccctgtgtgtagctcaggatttgtgagtacaccaatggacactctgtatctagctgctctggtagggccttggagaacctttatgtctagctcagggattgtaaatacaccaatcggcactctgtatctagctcaaggtttgtaaacacaccaatcagcaccctgtgtctagctcagggtttgtgagtgcaccaatcaacactctgtatctagctgctctcgtggggccttggagaacctttatgtctagctcagggattgtaaatacaccaatcggcactctgtatctagctcaaggtttgtaaacacaccaatcagcaccctgtgtttagctcaaagtttgtgagtgcaccaatcgacactctgtatctagctgctctggaggggccttggaggacctctgtgtccatattctgtatctaactaatctgatggggacgtggagaacctttgtatgtagctcagggattgtaaacgcaccaatcagcaccctgtcaaaacagaccactcggctctaccaatcagcaggatgtgggtggggccagataagagaataaaagcaggctgcccgagccagcagtggcaacctgcttgggtcgttttccacactgtggaaactttgttcttttgctctttgcaatagattttgctactgctcactttttgggtctacactgtttttatgatctgtaacactcaccgtaaaggtctgcagcttcactcctgaagccagcgagcccacgagcccactgagaggaaggaacaattccacacgcatgggcttaagagttgctaacactcactgtgaaggtttgcagcttcactcatgagccagcgagagcacaaacccaccagaaggaagaaactccgaacacatctgaacatcagaaggagcaaactccagacatgccaccttaagagctgtaacactcactgtgagggtctgtggcttcattcttgaagtcagtgagaccaagaacccaccaattccagacacactgggttcaagcgattttcctgcctcagcttctcgagtagctgggattacaggcatgtaattagccacaccatgcctggctaattttgtatttttagtacagatgggggttctcaattttggttaggctggtatcgaactcctggtgatctgcctgcctctgcttcccaaaatgctgggattacaggcgtgaatcgacaggcaagactgacatttttttttaaatgtaaaagttcttcaggaagaaaaaatttagatctatgcaaaaaagaatgaagtgtgctggaaatgataaatatatgggtaaaaataaaatttttttcatttaaattttaaaagataatatacttgagtaataatgaattatgaggcttatatgtagacataaaatgtatgacaacagtggtacaagggatagaaaaaggaaatggaagtgtactgtgttgagactctcatgcctttacaggaagaggaatgagctcactgggaggtagacagtgataaaggtgtatatcgtaaatcctagagcaaaggcacacaaataagaatgatatttaataagctaatggtggaaataaaatggggtcaaaaatgactcaggtcatggtgcagcggtttatgcctgtaatcctagccctttgggaggctgaggcaggtggatcacttgaggccaggagttagagaccagcctgggcaacgtggtgaaaccctgtctctactaaaaatacaaaaattagctgggcgtggtggcgcatgcctgtggttccagctactcaggaggccgaggcaggagaatcacttgaacctgggaagtggaattggcagtgagctgagatcccatcactgcactccagcctgagtgacagatcaagacgctcaaaaaacaaaacaaaacaaaaaacaaaatactgggttaattaaaaaaaaaaaaggcgaaaaatggaggaaaaggtaagaagatcagacgagaaaaatagaaaacaaatatgaagactattaaattcagggccagctacagtggttcacacttgtaattccagcactttttggggctgaggcaggaagattacttgagcccaggagttcgagacaagcccaggcaacatagggagaccccatctttacaagaaataaaaattaaaaagtaattagccaggcatcatgactcgtgcctgtgatcctagatagttcggaggctgaggcaggaggatttcttgagcttagaaagtcaaggctgcagtcagccgtgattgtgccactgcattatagcctgagtgacagagcaagactctgtctctaaaaaagaatcagacccaacgtatttataattacattaaatgtatatggtccagacaccacaattaaaaggcagagattgacacattggttaaaaaagaaagccccaaataaataatattcaaccaagaaatacattttaactaactataactacaaatagggtaaacaataggataaaaataagaggaagaaagatacggccatactgtatgttagccatgctaacatcaatttagaaaaaaattgagtgactatttcaaaatcagacaaaataggcttaagaagaggtatattattagggataaagagagacatttcataattataatcacaacacaatatttactaactacaaagggagaaaaaccagcctggatacaccttcttaatcaagtaatccaagagaacatcatcaatgatgggacacattgatattatctgtcacctgatagtatgcaaagagaagaatacagcatcacttcagtggttttcctggcaaagattaataacatgagcctaatcatgatgaaacattacaaaaactcagtttaaggaaaattctataaaataattgacctgtaatcttcaaaggttaaaagttatgaagatcaaaggaagactgaagaactgcaccagactgaagaagactaaagagacagaacaacgaaaaacaacacacgattctgaattgaactggtttactattaaagacattattagaacaactaacaaaacttgaaagggatctaaggatcaggtggcagcaatatattcatgtgaatttcttgatcttgatggctgtattatggttgcgtatgagaatatataaagtattgaaggataatgagacagattcagggaaaagggttctttgtgttatacttgttacaaaagaatttgtgattttttttttcaaaataaaaacaaagagaaattaaccagagtatgttattccagtgggtcttcattgtatttgagatgaaatttaacctttctaccatggtattttgctaaactctgagtatacccctgtcagcaaaagaaatgtgggcttatgttcttgtaaagaagagtttagaatataaagaatgtaaatacacctttgggttatgtgttgttaaaaaggcaggggtcctgcttcagagattatggttagaaaaggtctctctaccgcctcgttttctccttcagtaactacattccagccaccctggtctcctatttattcatgaatcacatcgagctcattaacaactcagggtatttgtacttatgctatcaatctgtgatgtccttctcctggcctttcaaattgctgccttcttttttttttttttttttaagatggagttttgcccttgttggccaggctggagtgcagtggtgcaatcttggctcactgcaacctccgccttccggttcaagtgattctcctgcctcagcctcctgaatagctgggattataggcatgcgccaccatgcctggctaattttgtatttttagtagagatggggtttctccatattggtcaggctggtcttgaactcccggcctcaggtgatccgcctgggattacaggcttgagccactgcgcccagcccaaatggctgccttcttatccttcagatctcagttcatatgtcagttcctcagagagaccttttctgactccagtatctaaagcagcaccactgctttctttaacagcacttaagccaatgtgtatttatattttatgttgtagctctcttctttactaaattataagcccatatcccttttgctgacaggagtatgcccagagtttagtaaaataccaggtacatgttaagccctcaataactgaataaataaatgaataagaagtactgagtatatgtgaaagtaacactatactaaacctgcaaattcatctttaacccattcccaccaccttatttgttctccacctcaggctctgagaataccacagccttcacaaaaggctccgacaccaccacagcctccatcacaggctctgagaccaccatggcctccaccatggcctctacttcggccttaactacaggctctaagatcaccacagactctaccacaggctctgagacaacctcagcctccaccatggcttctactgcagccttcaccacaggctctgagaccaacacggcctccaccacagactcagggactactatagcctccactaggaccttcaccacaggctctgacacaaccacaggctccactgcaggctctgaaactatcgtggcctccaccacagtctctgggaccacaacaacctttactatagcctccactacagtccctgagactaccatggcctccagcacaacctccactgcaggctctgagaaaacgatggcctcctccataatttctgagaccaccatggcctccaccacaggctctgagactgccacagtctctaccacaggctctgagaccaccaccacctccactgcaagctctgaggccactaaagtctctaccacaggctctgaaaccaccacagcatctactgcaggttctgagaccaccactacctccacctccatggcaggctctgaggccaccacaacctcaactgcagactccaaggtgatcacggcatccagcatgagctctgagaccactgtggcccccgctgcaggctctaacaccaccacagcctctaccacaggctctgagaccactacaatcctgattaaagcctctgagaccaccacagcctctacagcaggttctgagaccaccaccccctcccccacaggctctcagaccaccatagtctctatttcaggttctgagatcaccaccacctctacggcaggatccgagaacaccacagtctctagtgcaggctctgggaccaccacagcttctatggcaggctctgagaccaccgtctccactgcaggctctgagaccactacagtctctatcacaggcactgagaccaccatggtctctgccatgggctcagagaccaccacaaactctactacaagctctgagaccaccgtcacctctactgcaggctctgagaccaccacagtctccaccgtgggctctgagaccaccacagcctatactgcagattctgagaccactgcagcctctaccacaggctctgagatgaccacagtcttcactgcaggctcggaaaccatcacaccctctactgcaggctcagagaccaccacagtctctactgcaggctctgagaccactacagtctccaccacaggctctgagaccacaacagcctctactgcacattctgagacgactgcagcctccaccatgggctctgagaccaccaaagtctcaactgcaggctctgagaccacagtctccactgcaggctctgagaccactgcagcctctactgaagattctgaaaccaacacagcatttactgaagattctaagactaccacagcctctactacagggtttgagacaaccgcagcctctactacaggctctgagcctaccatggcatccaccatgggctctgagaccactatggcctctaccataggccctgagaccaccaaggtctccactgcaagctctgaggtgaccacagtctttgctgcaggctctgagacaatcagagcctctaccgtaggctctgagaccaccacagtctctaccacaggctctgagaccaccacagcctccatcatgggctctgagaccagcacagattctaccacaggctctgagaccaccacagcctctactgaaggctctgagaccaccacagcttccactgaaggctctgaggccactacagtctccaccacaggctctgagaccactacagtttctatcacagactcagagaccaccaccacctgtactgaaggctctgagatgactgcagtctccaccacagtctttgagaccactacagcctctactgaaggctctgagatcacaatagcctctacttcagactctgagaccaccacagcttctactgaaggttctgagaccactacagtcactaccgcaggctctgagaccaaaacagcctatactacaggctctgagaccaccacagcctctaatacaggcttggagaccaccacagtctttaccataggctctgacaccaccacagcctctactgaaggctctgagaccactgcagtctctgccacaggctctgagatgaccacagtctctactgaaggctctgagaacactacagtctccaccacaggctctgagaccactacagtttccaccacaggcttggagaccaccaccacttccactgaaggctctgagatgactacagtctccaccacaggtgctgagaccaccacagactctactgaaggctctgggaccactgcagcctccactgcaggctctgagaccaccacagtctctactgcagattctgagaacaccacagcatctactgcagattctgagaccacctcagcctctactacaggctctgagaccaccacagcctctactacaagctctgagaccaccacagcctctactgaaggctctgagaccactacagtctccaccacagactctgagaccaccatggtctctaccacaggctctgagaggaccatcacctctactgaaggctctgagaccactacagtatctgccacaggctctgagaccacagtctctactgaaggctctgggaccactacagtctccatcacaggctctgagaccactaaagtttctaccacaggttcagagaccaccaccacttctactgaaggctctgagattactacagcctccatcacaggctctgagaccaccacagcctctactgaaggctccgagaccaccacagcctctactgaaggctccgagaccacctcagcctctactacaggctctgagaccaccacagcctctactacaagctctgagaccaccatggcatccatcatgggctctgagaccactatggcctctaccataggctctgagaccaccaaggtctccactgcaagctctaaaatgaccacagtcttcactgaaaactctgagaccaccatagcctctaccacagcctctgagaccaccacagtctccactgcaggctctgagaccatcccagcctctacagcaggctctgagaccaccaccaccacctctactgaaggctctgagaccactacagcctctactgaaggctctgagaccaccacagcctctactgaaagctctgagaccactacagccactaccataggctctgagaccaccacagcctctactgaaggctctgagactaccaccacctctactgaaggctctgagaccaccacagcctctactgaaggctctgagatcactacagtttctaccacaggctctgagaccaccacagcctctactgaaggctctgagaccaccacagcctctactgaaggctctgagctcactacagtttctaccacaggctctgagaccatcacagtctctgctgaaggctctgagaccactacagtcactactatgggctctgagaccaccacggcctctactgcaggctcagagaccaccacagtctctactgcaggctctgagaccaccacagcctctattgaaggctctgagaccactacagtctcctccacaggctctgagaccaccacagtctctaccacaggcactgagactaccatcacctctactgaaggttcagagaccactacagtcactactgcaggttctgagaccacagcagtctataccacaggctctgagactaccaccacctctactgaaggctctgagacaaccacagtctctaccacgggctctgagaccaccacagcctctaccgcagatttggagaccaccacagtctccacctcaggctctgggaccaccacagcctctaccgcaggctctgagaccacaacagtctatatcacaggctctaagactaccaccgcctctactgaaggctctgaggccactacagtttctaccactagctctgagaccaccacagcctctaccacaggctctgagatgactacagtctttaccacagtctctgagaccaccacagtctctaccataggctctgaggccaccacatcctctgctgcaggctctgaggccaccaccacctctactgaaggctctgagaccaccacagcctccactgcaggctctgagaccaccacagcctccactgcaggctctgagaccaccacagcctccacttcaggctctgagaccaacacagcctgtaccacaggttctgagacctccacaccctccagtgcaggctctgagaccaacactgccttcatcataggctctgagagcaccatagcttccactgcaagcttggagcccactgcaacttccctcacaggctctgagaccaccacagtctctatcacagcttctggggccactgcagcctccaccactgtctcttccaccacgtttgtactcaccaaggccactgacgtttctatccagcccatcaccaacacacctatgtcaggtactaacccccatgtcttctttgagcccacacattttaactccagtggcaaccaccagctgttcacctgtttctatcatctctgccctggttcaagtcaagccagcacacagttagatataatttcctcttctaggctgggcgcggtggctcatgcctgtaatcccagcacattggaaggctgaggcgagcgaatcacgagatcaggagattgagaccatcctggctaacacggtgaaatccagtctctactaaaaatacaaaaaattagctgggcgtggtggcgggcacctgtagtcccagctactcggaaggctgaggcaggagaatgatgtgaatccgggaggtggagcttgcagtgagcagagatcgcgccattgcattccagcctgggcgacagagcgagactccgtctcaaaaaaaaaaaaaaaaatgtcctcttctggaatcctaattgcctctactctggtctcacctctttttttttaagtgcccaccacttccattgcaatcagaaccacaatatagtaaaccacaagtgcatcatatctgtcacatcttcctccagcaagcccgcctcaactctactggcccatcacagttttgtgaaatgctcccacttcggtgccaagtagattatctctattcaaccaaccatctgtgacactgccacctcctatcaatgtattgactctagaccagaggctggcagaccacatttcatgggtcaagtctcacctgttacctggttttgtaaagttttactggaacatagtcatgcccattcatttatggtttgtctccagctgcttttctgcttttccgtgtatttgcaacagagacagcctggcccaaaagcctaaattatttgctgtttggacctttacagaaaaaatttggcaacctttgctccagtctgagaccaaacaattttgttcattctctggcacttgccatcagcaagccggttacatctgattctatcctcttggttctaagcatactcacttctattctcatgactggtgctgtttgtgatcccattttaaccacttctgacctaggcacacccatcgctacctaagccgccaccaccgcctctgctgtgttgattcgtgctcacacctgtctgagcccaccctctcctatccctgtgagcagccttctccacttgggtcaggtcctcctacatctgcccaagcacactcacctcacctttgctgatcaccacagtgtggtagatgatgtcacctctgtcccagccacggccactggcatgcccatgagtgaatccaattctaccatctcctcctccagctccctccttacacccagtgatcacagtcacaaaagaagcagggcctgccgctttgtataccagcccacccacttatttgatctgctttgatttatttattttcaattttttccataagttattgggatgcaggtggtatttggttatatgaataagttctttagtggtgatttgtgagattttggtgcacccatcaccctagtagtatacactgcaccatatttgaagtcttttatccctcgccccctcccactcttcccccaaagtccccaaagtccattgcatcattcttatgtcttcgtatttccatagcttagctcccacatatcagtgagaacatacgatgttcggttttccattcctgagttacttcacttagaagaatagtctaaaatctcatccaggtcactgcaaatgctgttaattcattcatttttatcagcccaccctcttctatttgggtggccacttctgaagtcaaatagatcttccacttctgaacccatcgcgataacgtttcctcaaacttctgcctcctccatcaccaactccaccaggtgacacattctacctccttctctgtatgacacccacctgcattctggggacatggccacagcagaatcgctttctaccatctctcctcccccaccacacctctcctgagccacctccaccataggtttgttagattcaccctcctctggtctaagcacccccattcccctttaatcatctctgctacaaatgcatcatcttgtgtgacctgtttcataggcaccagaaccactggaaccagactcactgcctccagctctgtcaccatggcccctggaatggacttcacggcctctgctgccagccatactgtgccaggaatagtcttaaacacctctggcctgggtacatccactatgggagcatcatctaccacctcagcccacggcgtcaggaccaccacaggatccacccgtgagccaaccagcagcaccttccaggaaacaggcccggtgtccatgggcacaaacacagttagcatgagccacacacccacaaacgtgatcaaaccaagtggatatttacagccctgggctatcatcctcatttccctggctgcagttgtggctgctgttggattgtcagtaggactgagtttttgtctggtgagtacccagggtgggttcataggggagcctggcaagaaggcaggggggaatcatgtcagcagtgctttggaaaaatccagaatgagaaaggggagtaagttggtgcgctcagaaggaaagaatcacctagcctgatataaggaccagagagaatgcttaagtcagagaaagtgagaagcaaagtagaaaaagaggagggaaaagatggagttggggccaaagtgaagggaaatactgacagaacaagggaaatactgagagagaacaaggaggacataaacataaagaaagcaagaagcagctgggcgcagtggctcacccctgtaattccagcactttggaaggccaaggagggcggatcacttgagtccaggcatttgagaccagcctggccaacatggtgaaacttgtctttactaaaaatacaaaaattagtcgagagtggtagcatggacctgtagtcccagctactttggaggctgaggcacgagaattgcttgaacctgggagatggaggttgcagtgagcagagatcgtgccactgcactccagcctgagtgacagagcaagatcctgtctcgaaaggaaggaagaaagaaaagaaaggtaggaaggaaggaaggagagagagagagaaaaagagaaagaatgaggaagaaaggaagaaagcaagaaagagaaagaaaggaagaaagaaagaaagaaactgagagagaaagagaaagaaaaaagaaagaaggaaagaaagagagagagaaatagagaaaagaaagaagcataaaaatgttcagccatccaaaatgcgggcttccgattgtctcatgtatgacaaatttctggtcctcacagcaattccttgtgtggcctgtgactgttactctctgacctcccactccatctctgctctctggtcttgattgttctttgaatacatatttttcttacatcgatttcacatttattgatgttcttcctgttttcttgtgatcctgcgggtaagttaccatttgaggagtgaagcagagtataaatcagtggtgtgctggagctggctcatcctggcccacaagagattgtgcagttcttcccaattctgagctgagtgatgtgacactggtagcttaaaatatgctgggttggaaatacttacaccacagcaattgtcaaacactacaaatcagcacttttccctcggagagcctgttattaagtgttggacagcataccactggtaaaaatggacaaaatgaaaaatacggaagtcacaaaagatttggataatatagtcaatttgctgaggttctttgttttagaattctcagcctctctccgtatgtggactacataataaataccagcatctaagaattactccctaaattactttattatttcatttgcaagatcaagagagaataacgaaagtgaacattgagtttttactgcctgctaggctcaaggctgaatgtttaaaatgcataatgttatttaatctggcctacaatcccgtggccatattatattcatcttacaagtaagggatctggagcttcatgatcttagctatttgccccagcacatgtagtgagtggcagatataagactctaactcaggttagttggattctggagttcatgcctataatctcaaggctctgtgtagacagctttctagagctctcaattccacgtacctgttctgagctttcttagctgactaacaaagagaaagactgtctgtaaagtgagtctctgtgcctttcacataggggtatggatttacctttgtcttggaagtccaaaaacacataaccttatgatctgcagagctagggcctgagtacgcacataaagatgatatgttaataaggtaacaaggaagcttattttgtcagacggagaaagagtaaaagaacaaggaaaaagagagacagagacagagatcatagtaaggatggtggtaaagagaagagaacatgggcagtttggaaaagtgaaaatctgacattggtgaaacaggcatgtatggtgattagggagaggagacttaattttcatttatcaatgtatttatttttttcttttagagaaaccttttcttccccctgagatattgtggtatttattacccccatggccacagccacagccttggtctggacctgaacttgggcctgggctctgggacattccacagcctgggaaatgcactggttcatggaggagaacttgaaatgggacatggaggaacacacggctttggatatggagtgggccatggactgagccacatccatggagatggctacggagtgaatcatggcgggcattatggacatggaggaggccactgaggacaccatggagtggatcacagagggagccaccaaggaggccacggcaggacaagatggctgtggccatagattgggtatcaaaacatattatgggtgggagggggtcatggaggagaaaaaaataatgatcatgaaataattaaaatggagcataggaagcttcccaggatgtgatccatggagatggacatggactaggtcaagaaaagaaccagcaaaaggacctcagagactttgactggcttggaggggacttcaagtcaaagcttctgtgagtttttcctgagtctcagcctctgttgtggggagtcacgacaaccaccctcaggacatcttctctcccatttcccgccacatcagggtcaacgtttctcatccctgtgtttcctcatggtgctataaatattaccaagacatgtctaagaaacaaaagcacataatgaatgtattatcagggccac

SEQ ID NO: 1690 - DNA, 2348 bp, Homo sapiens
ctcatactcctcctccctcggccgtggcatcctgatattgctgatattcagacaccaagtcgttcatgttgctctcggcctcagtgaattccatctcatccatgccctcgcccgtgtaccagtggaggaaggccttgcgcctgaacgttgctgtaaactgctctgagacccgcttgagttcctggacggctgtgttgttcccagtgaaggtgactgacatttttagcccccagggtgggatgtcacagacggctgtttttacgttgttggggaaccagtcagcaaagtagctgctgttcttatcttgaatgttgaacatctgttcatccacctccctcatgggcatgcgaccctggaaaatggcagccgccgttaggtagcggccgtgacgggggtcacgggcagccatcatgttcttagcatcaaacatctgctgggtgagctcagccacagtcaaggcccggtactgctggctgccccggctggtcagtggggcaaagccgggcatgaagaaatgcagccggggaaacgggaccatgttcatggccagcttccgcaggtcagcattcagctggtcggggaagcacaggcacgtggtgaccccactcatggtagcagacaccaggtggttcaggtcaccataggtgggtgtgggcagttttagggtcctggaacatatgtcatatagcgcttcgttatctatgcagaaggtctcatctgcgttttctatgagctggtggactgagagggtggcgttgtagggctccaccacggtgtctgacaccttgggcaagagcaggatgctcaatgtgtttataatcctgtctgggtactcctcccagatcttactaatgagaagggtacccatcccagacccagtccccccacccagggagtgggtcagctggaaaccctgcaggcagtcacagctctcagcctcctttctgacaacgtccatcactgactccgtcagctccgcgccttcggtgtagcgtcccttggcccagttgtttccggccccacactgacctgtaagacagcacagccggtcactcgacggccaggtatacggtcatcagtggtcaccaccataatgcagaaagggccaagtgtcacgtgtgaggtgagagcaccattcgccctgcaggtggagcagatgaaaccccctcccccggagttacaggacagcagcttcccctctcttaggaattaagtcaggagtcaaacctgagaggggctaacctcactgcaggtggaacaaatgaaaacccctcccccggagttacaggacagcagcttcccccgttaggaattaagacaggagtcaaacctgagacgggctcacagaactcgctgcaggtggaacaaatgaaaccccctccccaggagttacaggacagcagcttcccctgttaggaattaagtcaggagtcgaacctgagacgggttcacagacctcgctgcaggtggcccattctcagggaaggcagtagccacggccccagctcaggtccttgcagggagtttacatcagtagctcctcaccttgaggagacacgcgggccttcctcccgaagcccgtttaggaggcagatggagcgactcgactcggaggacaggagggtgttcaggggccctggcgccacagttcccacaggatgaccttggagcgttcctggatttcgagctgccctggctaaggagccgcaccccagtcctcgcccgcagctcacgggaaatgaagttgtctggcctgaagacctgcccgaagggccccgagcgcacagagtccatggtgcccggctccagatccacgagcacagcgcgggacacgtacctgccacctgcgtggggcgggagggcatgagcgaggggagggccgcgttcccaggagggcggtgggggaaggacgggggtcgcaccgctggcctcgtggtggtgcacgttgatgcgctccagctgcaggtggctgtccccgtggtaggtgccagcggagtcgatggcatgttcatcagagatcacctcccagaactgcggagacgggaggggccagacaggccggggctgagtcacggaggcgccccagccgctctcccacccccatccgcacccccatccccaggccgccctgtccctggggtccacccccgccgcctcgccagccacccggttccaccgtccccggcagggagcccaggggccgcaatgcaggggcaccgcccccgccgctgccaacatcttccccggccacccggcaggcccgggctgggccctcagagccccggctgccaaccttggcgccgatctggttcccgcactgcccggtctgcgtgagcacaagctccctc
